United States Patent
Brogdon et al.

(10) Patent No.: US 10,174,095 B2
(45) Date of Patent: Jan. 8, 2019

(54) NUCLEIC ACID ENCODING A HUMANIZED ANTI-BCMA CHIMERIC ANTIGEN RECEPTOR

(71) Applicants: Novartis AG, Basel (CH); The Trustees of the University of Pennsylvania, Philadelphia, PA (US)

(72) Inventors: Jennifer Brogdon, Cambridge, MA (US); Eugene Choi, Cambridge, MA (US); Hilmar Erhard Ebersbach, Basel (CH); David Glass, Cambridge, MA (US); Heather Huet, Cambridge, MA (US); Carl H. June, Merion Station, PA (US); Joan Mannick, Cambridge, MA (US); Michael C. Milone, Cherry Hill, NJ (US); Leon Murphy, Cambridge, MA (US); Gabriela Plesa, Blue Bell, PA (US); Celeste Richardson, Cambridge, MA (US); Marco Ruella, Philadelphia, PA (US); Reshma Singh, Cambridge, MA (US); Yongqiang Wang, Shanghai (CN); Qilong Wu, Shanghai (CN)

(73) Assignees: Novartis AG, Basel (CH); The Trustees of the University of Pennsylvania, Philadelphia, PA (US)

(*) Notice: Subject to any disclaimer, the term of this patent is extended or adjusted under 35 U.S.C. 154(b) by 120 days.

(21) Appl. No.: 14/805,193

(22) Filed: Jul. 21, 2015

(65) Prior Publication Data

US 2016/0046724 A1 Feb. 18, 2016

(30) Foreign Application Priority Data

Jul. 21, 2014 (WO) ................ PCT/CN2014/082586
Nov. 6, 2014 (WO) ................ PCT/CN2014/090501

(51) Int. Cl.
| | | |
|---|---|---|
| C07H 21/04 | (2006.01) |
| C12N 15/63 | (2006.01) |
| C12N 5/00 | (2006.01) |
| C07K 16/28 | (2006.01) |
| C07K 14/705 | (2006.01) |
| A61K 35/12 | (2015.01) |
| A61K 38/17 | (2006.01) |
| C07K 14/715 | (2006.01) |
| C07K 19/00 | (2006.01) |
| A61K 39/395 | (2006.01) |
| A61P 35/00 | (2006.01) |

(52) U.S. Cl.
CPC ............ *C07K 14/705* (2013.01); *A61K 35/12* (2013.01); *A61K 38/177* (2013.01); *C07H 21/04* (2013.01); *C07K 16/2878* (2013.01); *C12N 5/00* (2013.01); *C12N 15/63* (2013.01); *A61K 39/395* (2013.01); *A61P 35/00* (2018.01); *C07K 14/7151* (2013.01); *C07K 16/28* (2013.01); *C07K 19/00* (2013.01); *C07K 2317/24* (2013.01); *C07K 2317/565* (2013.01); *C07K 2317/622* (2013.01); *C07K 2317/92* (2013.01); *C07K 2319/00* (2013.01); *C07K 2319/30* (2013.01)

(58) Field of Classification Search
None
See application file for complete search history.

(56) References Cited

U.S. PATENT DOCUMENTS

| | | |
|---|---|---|
| 3,929,992 A | 12/1975 | Sehgal et al. |
| 5,359,046 A | 10/1994 | Capon et al. |
| 5,665,772 A | 9/1997 | Cottens et al. |
| 5,686,281 A | 11/1997 | Roberts |
| 5,712,149 A | 1/1998 | Roberts |
| 5,874,240 A | 2/1999 | Ni et al. |
| 5,906,936 A | 5/1999 | Eshhar et al. |
| 5,912,172 A | 6/1999 | Eshhar et al. |
| 6,103,521 A | 8/2000 | Capon et al. |
| 6,319,494 B1 | 11/2001 | Capon et al. |
| 6,355,779 B1 | 3/2002 | Goodwin et al. |
| 6,407,213 B1 | 6/2002 | Carter et al. |
| 6,410,319 B1 | 6/2002 | Raubitschek et al. |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,083,785 B2 | 8/2006 | Browning et al. |
| 7,129,332 B2 | 10/2006 | Pastan et al. |

(Continued)

FOREIGN PATENT DOCUMENTS

| | | |
|---|---|---|
| CA | 2863799 A1 | 8/2013 |
| CN | 102875685 A | 1/2013 |

(Continued)

OTHER PUBLICATIONS

Carpenter et al (2013. Clin Cancer Res. 19(8): 2048-2060; published Apr. 15, 2013).*

(Continued)

*Primary Examiner* — Zachary C Howard
(74) *Attorney, Agent, or Firm* — Lando & Anastasi, LLP

(57) ABSTRACT

The invention provides compositions and methods for treating diseases associated with expression of BCMA. The invention also relates to chimeric antigen receptor (CAR) specific to BCMA vectors encoding the same, and recombinant T cells comprising the BCMA CAR. The invention also includes methods of administering a genetically modified T cell expressing a CAR that comprises a BCMA binding domain.

50 Claims, 62 Drawing Sheets

Specification includes a Sequence Listing.

(56) References Cited

U.S. PATENT DOCUMENTS

| | | |
|---|---|---|
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,627,643 B1 | 12/2009 | Ignatoff et al. |
| 7,628,986 B2 | 12/2009 | Weber et al. |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,943,743 B2 | 5/2011 | Korman et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,852,551 B2 | 10/2014 | Jordan |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,394,368 B2 | 7/2016 | Brogdon et al. |
| 9,573,988 B2 | 2/2017 | Brogdon et al. |
| 9,745,368 B2 | 8/2017 | Milone et al. |
| 2003/0060444 A1 | 3/2003 | Finney et al. |
| 2003/0077249 A1 | 4/2003 | Bebbington et al. |
| 2003/0148982 A1 | 8/2003 | Brenner et al. |
| 2003/0171546 A1 | 9/2003 | Jensen |
| 2003/0224520 A1 | 12/2003 | June et al. |
| 2004/0038886 A1 | 2/2004 | Finney et al. |
| 2004/0043401 A1 | 3/2004 | Sadelain et al. |
| 2005/0019429 A1 | 1/2005 | Ivanov et al. |
| 2005/0113564 A1 | 5/2005 | Campana et al. |
| 2005/0129671 A1 | 6/2005 | Cooper et al. |
| 2006/0246548 A1 | 11/2006 | Jensen |
| 2007/0036773 A1 | 2/2007 | Cooper et al. |
| 2008/0131415 A1 | 6/2008 | Riddell et al. |
| 2009/0088373 A1 | 4/2009 | Gallo et al. |
| 2009/0148419 A1 | 6/2009 | Gonzalez De La Pena et al. |
| 2009/0257994 A1 | 10/2009 | Jensen |
| 2009/0325167 A1 | 12/2009 | Chappell et al. |
| 2010/0105136 A1 | 4/2010 | Carter et al. |
| 2010/0196311 A1 | 8/2010 | Kim et al. |
| 2010/0273797 A1 | 10/2010 | Boman et al. |
| 2011/0052554 A1 | 3/2011 | Zakrzewski et al. |
| 2011/0129496 A1 | 6/2011 | Ahmed et al. |
| 2011/0280894 A1 | 11/2011 | Krackhardt et al. |
| 2012/0039906 A1 | 2/2012 | Olive |
| 2012/0138858 A1 | 6/2012 | Lee et al. |
| 2012/0148552 A1 | 6/2012 | Jensen |
| 2012/0244116 A1 | 9/2012 | Hiwase et al. |
| 2012/0282256 A1 | 11/2012 | Campana et al. |
| 2012/0321667 A1 | 12/2012 | Sentman |
| 2013/0040371 A1 | 2/2013 | Abe et al. |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0242049 A1 | 8/2014 | Choi et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370045 A1 | 12/2014 | June et al. |
| 2015/0017141 A1 | 1/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0306416 A1 | 10/2017 | Bedoya et al. |
| 2017/0335281 A1 | 11/2017 | Loew et al. |

FOREIGN PATENT DOCUMENTS

| | | |
|---|---|---|
| CN | 103113470 A | 5/2013 |
| CN | 103347897 A | 10/2013 |
| EP | 0574512 A1 | 12/1993 |
| EP | 0871495 A1 | 10/1998 |
| EP | 01226244 A2 | 7/2002 |
| EP | 1975231 B1 | 8/2011 |
| EP | 2694549 A1 | 2/2014 |
| WO | 1992015322 A1 | 9/1992 |
| WO | 09409010 A1 | 4/1994 |
| WO | 09418317 A1 | 8/1994 |
| WO | 199530014 A1 | 11/1995 |
| WO | 09623814 A1 | 8/1996 |
| WO | 09624671 A1 | 8/1996 |
| WO | 09625953 A1 | 8/1996 |
| WO | 09640140 A1 | 12/1996 |
| WO | 1997015669 A1 | 5/1997 |
| WO | 09723613 A2 | 7/1997 |
| WO | 09818809 A1 | 5/1998 |
| WO | 09900494 A2 | 1/1999 |
| WO | 09957268 A1 | 11/1999 |
| WO | 0014257 A1 | 3/2000 |
| WO | 01062931 A2 | 8/2001 |
| WO | 01/072325 A1 | 10/2001 |
| WO | 2002033101 A1 | 4/2002 |
| WO | 02077029 A2 | 10/2002 |
| WO | 02088334 A1 | 11/2002 |
| WO | 2003013598 A2 | 2/2003 |
| WO | 03057171 A2 | 7/2003 |
| WO | 2004106381 A1 | 12/2004 |
| WO | 2005000894 A2 | 1/2005 |
| WO | 2005019429 A2 | 3/2005 |
| WO | 2005044996 A2 | 5/2005 |
| WO | 2005090990 A2 | 9/2005 |
| WO | 2005/118788 A2 | 12/2005 |
| WO | 2006060878 A1 | 6/2006 |
| WO | 2006130458 A2 | 12/2006 |
| WO | 2007005874 A2 | 1/2007 |
| WO | 2008045437 A2 | 4/2008 |
| WO | 2008110491 A2 | 9/2008 |
| WO | 2008127735 A1 | 10/2008 |
| WO | 2010025177 A1 | 3/2010 |
| WO | 2010056754 A2 | 5/2010 |

(56) References Cited

FOREIGN PATENT DOCUMENTS

| | | | |
|---|---|---|---|
| WO | 2010077634 A1 | 7/2010 | |
| WO | 2010085660 A2 | 7/2010 | |
| WO | 2010104949 A2 | 9/2010 | |
| WO | 2011041093 A1 | 4/2011 | |
| WO | 2011059836 A2 | 5/2011 | |
| WO | 2011097477 A1 | 8/2011 | |
| WO | 201207414 A2 | 1/2012 | |
| WO | 2012025530 A1 | 3/2012 | |
| WO | 2012031744 A1 | 3/2012 | |
| WO | 2012033885 A1 | 3/2012 | |
| WO | 2012058460 A2 | 5/2012 | |
| WO | 2012066058 A1 | 5/2012 | |
| WO | 2012079000 A1 | 6/2012 | |
| WO | 2012082841 A2 | 6/2012 | |
| WO | 2012/099973 A2 | 7/2012 | |
| WO | 2012127464 A2 | 9/2012 | |
| WO | 2012129514 A1 | 9/2012 | |
| WO | 2012135854 A2 | 10/2012 | |
| WO | 2012138475 A1 | 10/2012 | |
| WO | 2012138858 A1 | 10/2012 | |
| WO | 2012163805 A1 | 12/2012 | |
| WO | WO 2012163805 A1 * | 12/2012 | ......... C07K 16/2878 |
| WO | 2013019615 A2 | 2/2013 | |
| WO | 2013026833 A1 | 2/2013 | |
| WO | 2013026837 A1 | 2/2013 | |
| WO | 2013026839 A1 | 2/2013 | |
| WO | WO 2013019615 A2 * | 2/2013 | ......... C07K 14/7051 |
| WO | 2013033626 A2 | 3/2013 | |
| WO | 2013040371 A2 | 3/2013 | |
| WO | 2013040557 A2 | 3/2013 | |
| WO | 2013059593 A1 | 4/2013 | |
| WO | 2013063419 A2 | 5/2013 | |
| WO | 2013074916 A1 | 5/2013 | |
| WO | 2013092001 A1 | 6/2013 | |
| WO | 2013/126712 A1 | 8/2013 | |
| WO | 2013123061 A1 | 8/2013 | |
| WO | 2013126726 A1 | 8/2013 | |
| WO | 2013126729 A1 | 8/2013 | |
| WO | 2013126733 A1 | 8/2013 | |
| WO | 2013142034 A1 | 9/2013 | |
| WO | 2013154760 A1 | 10/2013 | |
| WO | WO 2013154760 A1 * | 10/2013 | ......... C07K 14/7051 |
| WO | 2013173820 A2 | 11/2013 | |
| WO | 2013185552 A1 | 12/2013 | |
| WO | 2014/011984 A1 | 1/2014 | |
| WO | 2014/011987 A1 | 1/2014 | |
| WO | 2014/011993 A2 | 1/2014 | |
| WO | 2014/012001 A2 | 1/2014 | |
| WO | 2014011988 A2 | 1/2014 | |
| WO | 2014011996 A1 | 1/2014 | |
| WO | 2014031687 A1 | 2/2014 | |
| WO | 2014039513 A2 | 3/2014 | |
| WO | 2014/055442 A2 | 4/2014 | |
| WO | 2014055657 A1 | 4/2014 | |
| WO | 2014068079 A1 | 5/2014 | |
| WO | 2014100385 A1 | 6/2014 | |
| WO | 2014124143 A1 | 8/2014 | |
| WO | 2014130635 A1 | 8/2014 | |
| WO | 2014130657 A1 | 8/2014 | |
| WO | 2014/145252 A2 | 9/2014 | |
| WO | 2014144622 A2 | 9/2014 | |
| WO | 2014153270 A1 | 9/2014 | |
| WO | 2014/172584 A1 | 10/2014 | |
| WO | 2014186469 A2 | 11/2014 | |
| WO | 2015090229 A1 | 6/2015 | |
| WO | 2015090230 A1 | 6/2015 | |
| WO | 2015112626 A1 | 7/2015 | |
| WO | 2015/142661 A1 | 9/2015 | |
| WO | 2015142675 A2 | 9/2015 | |
| WO | 2016014501 A1 | 1/2016 | |
| WO | 2016014530 A1 | 1/2016 | |
| WO | 2016014535 A1 | 1/2016 | |
| WO | 2016014553 A1 | 1/2016 | |
| WO | 2016014565 A2 | 1/2016 | |
| WO | 2016014576 A1 | 1/2016 | |
| WO | 2016019300 A1 | 2/2016 | |
| WO | 2016025880 A1 | 2/2016 | |
| WO | 2016028896 A1 | 2/2016 | |
| WO | 2016044605 A1 | 3/2016 | |

OTHER PUBLICATIONS

Wells (1990) Biochemistry 29(37): 8509-8517.*
Ngo et al (1994) "The Protein Folding Problem and Tertiary Structure Prediction, Chapter 14: Computational Complexity Protein Structure Prediction, and the Levinthal Paradox" pp. 433-440 and 492-495 only.*
Bork (2000) Genome Research 10:398.*
Skolnick et al (2000) Trends in Biotech. 18(1): 34.*
Doerks et al (1998) Trends in Genetics 14(6): 248.*
Brenner (1999) Trends in Genetics 15(4): 132.*
Rudikoff et al (Proc Natl Acad Sci USA 1982 vol. 79 pp. 1979-1983).*
MacCallum et al. (Journal of Molecular. Biology, 1996, vol. 262, pp. 732-745).*
Pascalis et al (Journal of Immunology, 2002, vol. 169, pp. 3076-3084).*
Casset et al (Biochemical and Biophysical Research Communications, 2003, vol. 307, pp. 198-205).*
Vajdos et al (Journal of Molecular biology, 2002, vol. 320, pp. 415-428).*
Holm et al (Molecular Immunology, 2007, vol. 44, pp. 1075-1084).*
Chen et al. (Journal of Molecular Biology, 1999, vol. 293, pp. 865-881).*
Wu et al. (Journal of Molecular Biology, 1999, vol. 294, pp. 151-162).*
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Nakayashiki, et al., "Production of a Single-chain Variable Fragment Antibody Recognizing Type III Mutant Epidermal Growth Factor Receptor" Jpn. J. Cancer Res., 91:1035-1043 (2000).
NCBI accession HM_85952 accessed Sep. 29, 2015 from http://www.ncbi.nlm.nih.gov/nuccore/hm852952.
NCBI accession NM_001192.2 accessed Sep. 28, 2015 from <http://www.ncbi.nlm.nih.gov/nuccore/23238191>.
NCBI accession NP_001183.2 accessed Sep. 28, 2015 from <http://www.ncbi.nlm.nih.gov/protein/23238192>.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Notification of Transmittal of the International Search Report and Written Opinion of the International Search Authority for International Application No. PCT/US2014/065408 dated May 6, 2015.
Notification of Transmittal of the International Search Report and Written Opinion of the International Search Authority for International Application No. PCT/US2015/012284 dated May 8, 2015.
Novak et al. "Expression of BCMA, TACI, and BAFF-R in multiple myeloma: a mechanism for growth and survival", Blood (2004) vol. 103 No. 2, pp. 689-694.
Ohno, et al., "Expression of miR-17-92 enhances anti-tumor activity of T-cells transduced with the anti-EGFRvIII chimeric antigen receptor in mice bearing human GBM xenografts" Journal of ImmunoTherapy of Cancer, 1:21 (2013).
Ohno, et al., "Retrovirally engineered T-cell-based immunotherapy targeting type III variant epidermal growth factor receptor, a glioma-associated antigen" Cancer Science, 101(12):2518-2524 (2010).
Okamoto, et al., "Monoclonal antibody against the fusion junction of a deletion-mutant epidermal growth factor receptor" British Journal of Cancer, 73:1366-1372 (1996).
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.

(56) References Cited

OTHER PUBLICATIONS

Paul, W.E. Fundamental Immunology, 3rd Edition, 1993, pp. 292-295.
Pelekanou et al. "BAFF, APRIL, TWEAK, BCMA, TACI and Fn14 Proteins Are Related to Human Glioma Tumor Grade: Immunohistochemistry and Public Microarray Data Meta-Analysis" Plos One (2013) vol. 8 No. 12 pp. 1-11.
Pizzitola et al, "Chimeric antigen receptors against CD33/CD123 antigens efficiently target primary acute myeloid leukemia cells in vivo", Leukemia (2014) vol. 28 No. 8 pp. 1596-1605.
Porter et al., "Chimeric antigen receptor-modified T cells in chronic lymphoid leukemia," New England Journal of Medicine 365: 725-733 (2011).
Prinz et al., "High DGK-a and Disabled MAPK Pathways cause Dysfunction of Human Tumor-Infiltrating CD8+ T Cells That Is Reversable by Pharmacologic Intervention," The Journal of Immunology 188: 5990-6000, 2012.
Prosser, et al., "Tumor PD-L1 co-stimulates primary human CD8+ cytotoxic T cells modified to express a PD1: CD28 chimeric receptor" Molecular Immunology, 51:263-272 (2012).
Radhika et al., "Targeting Leukemias by CD123 Specific Chimerica Antigen Receptor" Blood(ASH Annual Meeting Abstracts) 118(21): abstract 1908 (2011).
Rambaldi et al, "Cell-based strategies to manage leukemia relapse: efficacy and feasibility of immunotherapy approaches",Leukemia (2014).,vol. 29, No. 1, pp. 1-10.
Riese et al "Enhanced Effector Responses in Activated CD8+ T Cells Deficient in Diacylglycerol Kinases", Cancer Research (2013) vol. 73 No. 12 pp. 3566-3577.
Riet et al. "Nonviral RNA transfection to transiently modify T cells with chimeric antigen receptors for adoptive therapy", Methods in Molecular Biology, Humana Press, Inc, US, vol. 969, Jan. 1, 2013, pp. 187-201.
Romeo et al., "Cellular immunity to HIV activated by CD4 fused to T cell or Fc receptor polypeptides," Cell 64:1037-1046 (1991).
Rouas et al. "Lentiviral-mediated gene delivery in human monocyte-derived dendritic cells: Optimized design and procedures for highly efficient transduction compatible with clinical constraints". Cancer Gene Therapy (2002) vol. 9 pp. 715-724.
Sadelain et al., "Targeting Tumours with Genetically Enhanced T Lymphocytes," Nature Reviews: Cancer 3: 35-45 (2003).
Sagiv-Barfi, et al., "Ibrutinib enhances the antitumor immune response induced by intratumoral injection of a TLR9 ligand in mouse lymphoma" Blood, 125(13):2079-2086 (2015).
Sagiv-Barfi, et al., "Therapeutic antitumor immunity by checkpoint blockade is enhanced by ibrutinib, an inhibitor of both BTK and ITK" PNAS, 112(9):E966-E972 (2015).
Sampson, et al., "EGFRvIII mCAR-Modified T-Cell Therapy Cures Mice with Established Intracerebral Glioma and Generates Host Immunity against Tumor-Antigen Loss" Clinical Cancer Research, 20(4):972-984 (2013).
Shirasu et al., "Functional Design of Chimeric T-Cell Antigen Receptors for Adoptive Immunotherapy of Cancer: Architecture and Outcomes," AntiCancer Res. 32: 2377-2384 (2012).
Singh, et al., "Third Generation Chimeric Antigen Receptors Containing CD137 or CD134 Signaling Endodomains Augment CD19-Specific T-Cell Effector Function" Blood: Ash Annual Meeting Abstracts; 114:22 (2009).
Smirnova et al. "Identification of new splice variants of the genes BAFF and BCMA", Molecular Immunology (2008) vol. 45, pp. 1179-1183.
Stromnes et al. "Abrogation of Src Homology Region 2 Domain-Containing Phosphatase 1 in Tumor-Specific T Cells Improves Efficacy of Adoptive Immunotherapy by Enhancing the Effector Function and Accumulation of Short-Lived Effector T Cells In Vivo",The Journal of Immunology, (2012) vol. 189, No. 4, pp. 1812-1825.
Tettamanti et al. "Targeting of the acute myeloid leukemia stem cells through immunotherapy: development of novel chimeric receptors specific for the CD123 antigen," OMICS group conference 2nd world congress on biotechology (2011) retrieved from internet www.omicsonline.org/biotechnology2011.
Uniprot identifier Q02223-2 accessed Sep. 28, 2015 from <http://www.uniprot.org/uniprot/Q02223>.
Urbanska et al., "A Universal Strategy for Adoptive Immunotherapy of Cancer Through Use of a Novel T-Cell Antigen Receptor," Cancer Res. 72(7): 1844-1852 (2012).
Van Duyne et al. "Atomic Structure of the Rapamycin Human Immunophilin FKBP-12 Complex" American Chemical Society (1991) vol. 113, pp. 7433-7434.
Wang et al. "Overcoming intrinsic inhibitory pathways to augment the antineoplastic activity of adoptively transferred T cells: Re-tuning your CAR before hitting a rocky road", Oncoimmunology (2013) vol. 2, No. 11, p. e264921-3.
Weijyens, "Immuno-gene therapy for renal cancer chimeric receptor-mediated lysis of tumorcells," Thesis: 1-128 (2001).
Written Opinion for PCT Application No. PCT/US2014/034570 dated Oct. 17, 2015.
Written Opinion for PCT/US13/63083. dated Jan. 17, 2014.
Written Opinion of the International Searching Authority for International Application No. PCT/US13/032029, dated Oct. 11, 2014.
Xu V et al: "Closely related T-memory stem cells correlate with in vivo expansion of CAR.CD19-T cells and are preserved by IL-7 and IL-15", Blood, vol. 123, No. 24, Apr. 29, 2014 (Apr. 29, 2014), pp. 3750-3759, XP055201372, ISSN: 0006-4971, DOI:10.1182/blood-2014-01-552174.
Zhao et al. "Targeting C-type lectin-like molecule-1 for antibody-mediated immunotherapy in acute myeloid leukemia", Haematologica (2010) vol. 95 No. 1 pp. 71-78.
Zhong et al., "Enhanced T cell response due to diacylglycerol kinase deficiency" Nature Immunology 4(9): 882-890 (2003).
International Search Report and Written Opinion for PCT/US2015/041337 dated Oct. 19, 2015.
International Search Report and Written Opinion of the International Search Authority for International Application No. PCT/CN2014/082586 dated Apr. 24, 2015.
International Search Report and Written Opinon for PCT/US2013/057991, dated Jan. 3, 2014.
International Search Report for International Application No. PCT/US13/032029, dated Jun. 20, 2013.
International Search Report for International Application No. PCT/US13/63083, dated Jan. 17, 2014.
International Search Report for International Application No. PCT/US2013/027347, dated Apr. 30, 2013.
International Search Report for International Application No. PCT/US2013/050267, dated Nov. 29, 2013.
International Search Report for International Application No. PCT/US2013/050272, dated Nov. 12, 2013.
International Search Report for International Application No. PCT/US2013/050275, dated Dec. 17, 2013.
International Search Report for International Application No. PCT/US2013/050287, dated Dec. 2, 2013.
International Search Report for International Application No. PCT/US2013/050293, dated Dec. 9, 2013.
International Search Report for International Application No. PCT/US2014/017364, dated Jul. 8, 2014.
International Search Report for PCT Application No. PCT/US2014/034570 dated Aug. 12, 2014.
International Search Report including Written Opinon for PCT/US2014/017328 dated Jun. 26, 2014.
Invitation to Pay Additional Fees and, Where Applicable, Protest Fee for International Application No. PCT/US2014/065408, dated Feb. 4, 2015.
Irving et al., "The cytoplasmic domain of the T cell receptor zeta chain is sufficient to couple to receptor-associated signal transduction pathways," Cell 64: 891-901 (1991).
Jena et al. "Chimeric Antigen Receptor (CAR)-Specific Monoclonal Antibody to Detect CD19-Specific T Cells in Clinical Trials," PLOS 8(3): e57838 (2013).
Jena, Bipulendu et al. "Redirecting T-cell specificity by introducing a tumor-specific chimeric antigen receptor, Blood, May 3, 2010", vol. 116, No. 7, pp. 1035-1044.

(56) References Cited

OTHER PUBLICATIONS

John et al, "Anti-PD-1 antibody therapy potently enhances the eradication of established tumors by gene-modified T cells", Clinical Cancer Research, The American Association for Cancer Research, US (2013) vol. 19, No. 20, pp. 5636-5646.
Kalos et al. "Adoptive T Cell Transfer for Cancer Immunotherapy in the Era of Synthetic Biology", Immunity, Cell Press, US, vol. 39, No. 1, Jul. 25, 2013. pp. 49-60.
Kalos et al., "T cells with chimeric antigen receptors have potent antitumor effects and can establish memory in patients with advanced leukemia," Science Translational Medicine 3: 95ra73 (2011).
Kerkar. "'Model T' Cells: A Time-Tested Vehicle for Gene Therapy." Frontiers in Immunology 4 (2013): 304. PMC. Web. Aug. 18, 2015.
Kershaw et al. "Gene-engineered T cells for cancer therapy", Nature Reviews Cancer, vol. 13, No. 8, Jul. 24, 2013, pp. 525-541.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-of-Hematology (ASH); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).
Krebs et al. "Genetically Modified T Cells to Target Glioblastoma", Frontiers in Oncology, vol. 3, Jan. 1, 2013.
Kuhn, et al., "Determinants of intracellular RNA pharmacokinetics: Implication for RNA-based immunotherapeutics" RNA Biology, 8(1):35-43 (2011).
Kuwana et al., "Expression of Chimeric Receptor Composed of Immunoglobulin-derived V Resions and T-cell Receptor-derived C Regions" Biochem. Biophys. Res. Commun. 149: 964-968 (1987).
Kwon et al., "cDNA sequences of two inducible T-cell genes". Proc. Natl. Acad. Sci. U.S.A. 86(6): 1963-1967 (1989).
Laabi et al. "The BCMA gene, preferentially expressed during B lymphoid maturation, is bidirectionally transcribed", Nucleic Acids Research (1994) vol. 22, No. 7, pp. 1147-1154.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Lanitis et al., "Redirected Antitumor Activity of Primary Human Lymphocytes Transduced With a Fully Human Anti-mesothelin Chimeric Receptor" Molecular Therapy, 20(3):633-643 (2012).
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Liu et al, "Metformin and the mTOR Inhibitor Everolimus (RAD001) Sensitize Breast Cancer Cells to the Cytotoxic Effect of Chemotherapeutic Drugs In Vitro", Anticancer Research, 32: 1627-1638 (2012).
Lorimer, et al., "Recombinant immunotoxins specific for a mutant epidermal growth factor receptor: Targeting with a single chain antibody variable domain isolated by phage display" Proc. Natl. Acad. Sci. USA, 93:14815-14820 (1996).
MacCallum R.M. et al, Antibody-antigen interactions: Contact analysis and binding site topography. J. Mol. Bioi., 1998, vol. 262, p. 732-745.
Maher et al., "Human T lymphocyte cytotoxicity and proliferation directed by a single chimeric TCRzeta/CD28 receptor," Nat. Biotechnol. 20: 70-75 (2002).
Mardiros et al., "CD123-Specific Chimeric Antigen Receptor Redirected T Cells Exhibit Potent Cytolytic Activity and Multiple Effector Functions Against Acute Myeloid Leukemia without Altering Normal Hematopoietic Colony Formation in Vitro" Blood 120(21): abstract 950 (2011).
Maus et al., "T cells expressing chimeric antigen receptors can cause anaphylaxis in humans" Cancel Immunol Res, 1:26-31 (2013).
Maus, Marcela V. et al. "Zoom zoom: racing CARs for multiple myeloma", Clinical Cancer Research, Apr. 15, 2013, vol. 19 No. 8, pp. 1917-1919.
McAlpine et al. "Revised NMR Assignments for Rapamycin", The Journal of Antibiotics (1991) vol. 44 No. 6, pp. 688-690.
McCormack et al., "Bi-specific TCR-anti CD3 redirected T-cell targeting of NY-ESO-1-and LAGE-1-positive tumors," Cancer Immunol. Immunother. 62:773-785 (2012).
McGuinness et al., "Anti-tumor activity of human T cells expressing the CC49-zeta chimeric immune receptor," Hum. Gene Ther. 10: 165-173 (1999).
Melero et al., "Amplification of Tumor Immunity by Gene Transfer of the Co-Stimulatory 4-1BB Ligand: Synergy with the CD28 Co-Stimulatory Pathway," Eur. J. Immunol. 28(3): 1116-1121 abstract (1998).
Moon, et al., "A PDI-CD28 'Switch Receptor' Is Able to Augment Mesothelin-Directed Chimeric Antigen Receptor T Cell Therapy in a Resistant In Vivo Model of Human Tumor" 17th Annual Meeting of the American Society of Gene and Cell Therapy, Abstract 520 (May 21-24, 2014).
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Morgan, et al., "Recognition of Glioma Stem Cells by Genetically Modified T Cells Targeting EGFRvIII and Development of Adoptive Cell Therapy for Glioma" Human Gene Therapy, 23:1043-1053 (2012).
Bakker et al. "C-typelectin-like molecule-1: a novel myeloid cell surface marker associated with acute myeloid leukemia", Cancer Research (2004) vol. 64, No. 22,pp. 8443-8450.
Barrett, et al., "Pre-clinical model of eradication of B cell leukemia with lentiviral transduced anti-CD19 chimeric immunoreceptor-modified T cells" Cancer Research:AACR 101st Annual Meeting, Abstract 2933 (Apr. 17-21, 2010).
Barrett, et al., "Treatment of Advanced Leukemia in Mice with mRNA Engineered T Cells" Human Gene Therapy, 22(12):1575-1586 (2011).
Beers, et al., "Immunotoxins with Increased Activity against Epidermal Growth Factor Receptor vIII-expressing Cells Produced by Antibody Phage Display" Clinical Cancer Research, 6:2835-2843 (2000).
Bendig, M.M. Humanization of rodent monoclonal antibodies by CDR grafting. Methods: A Companion to Methods in Enzymology, 1995; vol. 8, p. 83-93.
Birkholz et al. "Transfer of mRNA encoding recombinant immunoreceptors reprograms CD4+ and CD8+ T cells for use in the adoptive immunotherapy of cancer," Gene Therapy 16:596-604 (2009).
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brown J R et al: "Novel Treatments for Chronic Lymphocytic Leukemia and Moving Forward",American Society of Clinical Oncology Educational Book,vol. 34, 2014, pp. e317-e325,XP05520 1368,ISSN: 1548-8748, DOI:10.14694/EdBook_AM.2014..34. e317 the whole document.
Bullain, et al., "Genetically engineered T cells to target EGFRvIII expressing glioblastoma" J Neurooncol, 94:373-382 (2009).
Carpenter, Robert O. et al. "B-cell Maturation Antigen is a Promising Target for Adoptive T-cell Therapy of Multiple Myeloma", Clinical Cancer Research, Apr. 15, 2013, vol. 19 No. 8, pp. 2048-2060.

(56) References Cited

OTHER PUBLICATIONS

Casset F, et al. A peptide mimetic of an anti-CD4 monoclonal antibody by rational design. Biochemical and Biophysical Research Communications, 2003, vol. 307, p. 198-205.

Casucci et al. "CD44v6-targeted T cells mediate potent antitumor effects against acute myeloid leukemia and multiple myeloma", Blood (2013) vol. 122 No. 20 pp. 3461-3472.

Chinnasamy et al. "Local Delivery of Interleukin-12 Using T Cells Targeting VEGF Receptor-2 Eradicates Multiple Vascularized Tumors in Mice", Clinical Cancer Research, vol. 18, No. 6, Jan. 30, 2012, pp. 1672-1683.

Chiu et al. "Hodgkin lymphoma cells express TACI and BCMA receptors and generate survival and proliferation signals in response to BAFF and APRIL", Blood (2007) vol. 109 No. 2, pp. 729-739.

Chmielewski et al. "IL-12 Release by Engineered T Cells Expressing Chimeric Antigen Receptors Can Effectively Muster an Antigen Receptors Can Effectively Muster an Antigen-Independent Macrophage Response on Tumor Cells That Have Shut Down Tumor Antigen Expression", Cancer Research, vol. 71, No. 17, Jul. 8, 2011, pp. 5697-7506.

Chmielewski et al. "Of CARs and TRUCKs: chimeric antigen receptor (CAR) T cells engineered with an inducible cytokine to modulate the tumor stroma", Immunological Reviews, vol. 257, No. 1, Jan. 13, 2014, pp. 83-90.

Claudio et al. "A molecular compendium of genes expressed in multiple myeloma", Blood (2002) vol. 100 No. 6, pp. 2175-2186.

Deshayes et al. "Abnormal production of the TNF-homologue APRIL increases the proliferation of human malignant glioblastoma cell lines via a specific receptor", Oncogene (2004) vol. 23 No. 17, pp. 3005-3012.

Dotti et al. "Design and development of therapies using chimeric antigen receptor-expressing T cells", Immunological Reviews, vol. 257, No. 1, Dec. 13, 2013, pp. 107-126.

Du et al., "New Immunotoxins Targeting CD123, a Stem Cell Antigen on Acute Myeloid Leukemia Cells" J. Immunother. vol. 30, No. 6 pp. 607-613 (2007).

Elsawa et al. "Cytokines in the Microenvironment of Waldenström's Macroglobulinemia", Clin Lymphoma Myeloma (2009) vol. 9 No. 1 pp. 43-45.

Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).

European Search Report for EP Application No. 12820516.8, dated Mar. 30, 2015.

Extended European Search Report for EP Application No. 12832609.7, dated Mar. 25, 2015.

Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).

Finney et al., "Chimeric receptors providing both primary and costimulatory signaling in T cells from a single gene product," J. Immunol. 161: 2791-2797 (1998).

Friedmann-Morvinski et al., "Redirected primary T cells harboring a chimeric receptor require costimulation for their antigen-specific activation," Blood 105: 3087-3093 (2005).

Garfall, et al. "Imunotherapy with chimeric antigen receptors for multiple myeloma." Discovery Medicine. 17 (91) (pp. 37-46), Jan. 2014.

Gaviolo et al., "Protein kinase C mediates human neutrophil cytotoxicity" Biochemical and Biophysical Research Communications 148(3): 1290-1294 (1987).

Geiger et al., "Integrated src kinase and constimulatory activity enhances signal transduction through single-chain chimeric receptors in T lymphocytes," Blood 98(8): 2364-2371 (2001).

Gill et al. "Preclinical targeting of human acute myeloid leukemia and myeloablation using chimeric antigen receptor-modified T cells", Blood (2014) vol. 123 No. 23 pp. 2343-2345.

Gonzalez et al. "Genetic engineering of cytolytic T lymphocytes for adoptive T-cell therapy of neuroblastoma," The Journal of Gene Medicine 6(6): 704-711 (2004).

Gross et al., "Endowing T cells with antibody specificity using chimeric T cell receptors," The FASEB Journal 6: 3370-3378 (1992).

Gross et al., "Expression of immunoglobulin-T-cell receptor chimeric molecules as functional receptors with antibody-type specificity," PNAS 86: 10024-10028 (1989) (discuss "gene pair approach:" VH spliced to the C-region gene segment of alpha or beta TcR chain, or gamma or zeta TcR chain, VL is attached to the other chain).

Grupp et al., "Chimeric antigen receptor-modified T cells for acute lymphoid leukemia," New England Journal of Medicine 368: 1509-1518 (2013).

Gupta, et al., "Development of an EGFRvIII specific recombinant antibody" BMC Biotechnology, 10(72):1-13 (2010).

Holtkamp, et al., "Modification of antigen-encoding RNA increases stability, translational efficacy, and T-cell stimulatory capacity of dendritic cells" Blood, 108(13):4009-4071 (2006).

Hombach et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).

Hoyos et al. "Engineering CD19-specific T lymphocytes with interleukin-15 and a suicide gene to enhance their anti-lymphoma/leukemia effects and safety", Leukemia, vol. 24, No. 6, Apr. 29, 2010, pp. 1160-1170.

Hunder et al., "Treatment of Metastic Melanoma with Autologous CD4+ T Cells against NY-ESO-'1." The New England Journal of Medicine 358(25): 2698-2703 (2008).

Huye E L et al: 'Combining mTor Inhibitors With Rapamycin-resistant T Cells: A Two-pronged Approach to Tumor Elimination',Molecular Therapy,vol. 19, No. 12,Aug. 30, 2011 (Aug. 30, 2011), pp. 2239-2248, XP055191016, GB, ISSN: 1525-0016, DOI: 10.1038/mt.2011.179 the whole document.

Imai et al., "Chimeric receptors with 4-1BB signaling capacity provoke potent cytotoxicity against acute lymphoblastic leukemia," Leukemia 18: 676-684 (2004).

International Search Report and Written Opinion for International Application No. PCT/CN2014/090501, dated Jun. 5, 2015.

International Search Report and Written Opinion for International application No. PCT/CN2014/090503, dated Apr. 22, 2015.

International Search Report and Written Opinion for International Application No. PCT/CN2014/094383, dated Mar. 20, 2015.

International Search Report and Written Opinion for International application No. PCT/CN2014/094393, dated Mar. 30, 2015.

International Search Report and Written Opinion for International Application No. PCT/US2014/065408, dated May 6, 2015.

International Search Report and Written Opinion for International application No. PCT/US2015/024671, dated Jul. 31, 2015.

International Search Report and Written Opinion for PCT/US2015/020606 dated Sep. 14, 2015.

Pule et al., "Virus-specific T cells engineered to coexpress tumor-specific receptors: persistence and antitumor activity in individuals with neuroblastoma" Nat. Med. (2008) vol. 14 No. 11 pp. 1264-1270.

Rapoport et al., "Restoration of immunity in lymphopenic individuals with cancer by vaccination and adoptive T-cell transfer" Nature Medicine (2005) vol. 11 No. 11 pp. 1230-1237.

Roederer, "T-cell dynamics of immunodeficiency" Nature Medicine (1995) vol. 1 No. 7 pp. 621-622.

Sabbagh et al., "TNF family ligands define niches for T cell memory" Trends in Immunology (2007) vol. 28 No. 8 pp. 333-339.

Sadelain et al. "The promise and potential pitfalls of chimeric antigen receptors." Current Opinion Immunology (2009) vol. 21 No. 2 pp. 215-223.

Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.

Sebestyen et al., "Human TCR That Incorporate CD3 Induce Highly Preferred Pairing between TCR and Chains following Gene Transfer" Journal of Immunology (2008) vol. 180 pp. 7736-7746.

(56) References Cited

OTHER PUBLICATIONS

Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Baeksgaard & Sorensen, "Acute tumor lysis syndrome in solid tumors—a case report and review of the literature" Cancer Chemotherapy Pharmacology (2003) vol. 51 pp. 187-192.
Bondanza et al. "Suicide gene therapy of graft-versus-host disease induced by central memory human T lymphocytes" Blood (2006) vol. 107 No. 5 pp. 1828-1836.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor-Chain alone Are Insufficient to Prime Resting T Lymphocytes" J. Exp. Med. (1995) vol. 181 pp. 1653-1659.
Call & Wucherpfennig, "The T Cell Receptor: Critical Role of the Membrane Environment in Receptor Assembly and Function" Annu. Rev. Immunol. (2005) vol. 23 pp. 101-125.
Carpenito et al. "Control of large, established tumor xenografts with genetically retargeted human T cells containing CD28 and CD137 domains", Proc Natl Acad Sci USA (2009) vol. 106 pp. 3360-3365.
Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al, "A Third-Generation Lentivirus Vector with a Conditional Packaging System" Journal of Virology (1998) vol. 72 No. 11 pp. 8463-8471.

Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Geiger & Jyothi, "Development and Application of Receptor-Modified T Lymphocytes for Adoptive Immunotherapy" Transfusion Medicine Reviews (2001) vol. 15 No. 1 pp. 21-34.
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcina-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Hekele et al., "Growth Retardation of Tumors by Adoptive Transfer of Cytotoxic T Lymphocytes Reprogrammed by CD44V6-Specific SCFV:—Chimera" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Imai et al., "Genetic modification of primary natural killer cells overcomes inhibitory signals and induces specific killing of leukemic cells" Blood (2005) vol. 106 No. 1 pp. 376-383.
International Search Report and Written Opinion for International Application No. PCT/US2015/041378 dated Jan. 21, 2016.
International Search Report from PCT/US2011/064191 dated Jan. 5, 2012.
Jensen et al., "Anti-Transgene Rejection Responses Contribute to Attenuated Persistence of Adoptively Transferred CD20/19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
June et al., "Engineering lymphocyte subsets: tools, trials and tribulations" Nat Rev Immunol (2009) vol. 9 No. 10 pp. 704-716.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kim et al., "Human 4-1BB regulates CD28 co-stimulation to promote Th1 cell responses" Eur. J. Immunol. (1998) vol. 28 pp. 881-890.
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.

(56) References Cited

OTHER PUBLICATIONS

Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Levine et al., "Gene transfer in humans using a conditionally replicating lentiviral vector" PNAS (2006) vol. 103 No. 46 pp. 17372-17377.
Macallan et al., "Measurement and modeling of human T cell kinetics" European Journal of Immunology (2003) vol. 33 pp. 2316-2326.
Maus et al. "Antibody derivatives as new therapeutics for hematologic malignancies" Blood (2014) vol. 123, No. 17, pp. 2625-2635.
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Molina, "A Decade of Rituximab: Improving Survival Outcomes in Non-Hodgkin's Lymphoma" Annu. Rev. Med. (2008) vol. 59 pp. 237-250.
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric Antigen Receptor Therapy for B-cell Malignancies" Journal of Cancer (2011) vol. 2 pp. 331-332.
Altvater et al. "2B4 (CD244) Signaling by Recombinant Antigen-specific Chimeric Receptors Costimulates Natural Killer Cell Activation to Leukemia and Neuroblastoma Cells" Clinical Cancer Research (2009) vol. 15, No. 15, pp. 4857-4866.
Eshhar et al. "Specific activation and targeting of cytotoxic lymphocytes through chimeric single chains consisting of antibody binding domains and the y or C subunits of the immunoglobulin and T-cell receptors" PNAS (1993) vol. 90, pp. 720-724.
Finney et al. "Activation of Resting Human Primary T Cells with Chimeric Receptors: Costimulation from CD28, Inducible Costimulator, CD134, and CD137 in Series with Signals from the TCRz Chain" The Journal of Immunology (2004) vol. 172, pp. 104-113.
Jensen et al. "Design and implementation of adoptive therapy with chimeric antigen receptor-modified T cells" Immunological Reviews (2014) vol. 257, pp. 127-144.
Singapore Search Report and Written Opinion for Singapore Application No. 11201700476V dated Nov. 6, 2017.
Song et al. "CD27 costimulation augments the survival and antitumor activity of redirected human T cells in vivo" Blood (2012) Bol 119, No. 3, pp. 696-706.
Wang et al. "A Chimeric Antigen Receptor (CARs) Based Upon a Killer Immunoglobulin-Like Receptor (KIR) Triggers Robust Cytotoxic Activity in Solid Tumors" Molecular Therapy (2014) vol. 22, Supplement 1, pp. S57.
Wang et al. "Generation of Potent T-cell Immunotherapy for Cancer Using DAP12-Based, Multichain, Chimeric Immunoreceptors" Cancer Immunology Research (2015) vol. 3, No. 7, pp. 815-826.

\* cited by examiner

Anti-BCMA scFv pBCMA 1 | CD8 Leader | VL | Linker | VH | IgG4 hinge | 41-BB | TCRz |
230 aa pBCMA 2 | CD8 Leader | VH | Linker | VL | IgG4 hinge | 41-BB | TCRz | pBCMA 3 | CD8 Leader | VL | Linker | VH | hCD8a hinge | 41-BB | TCRz |
45 aa pBCMA 4 | CD8 Leader | VH | Linker | VL | hCD8a hinge | 41-BB | TCRz |

FIG. 5

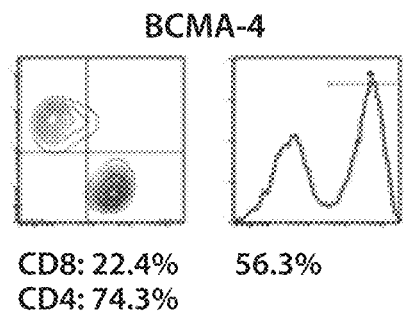
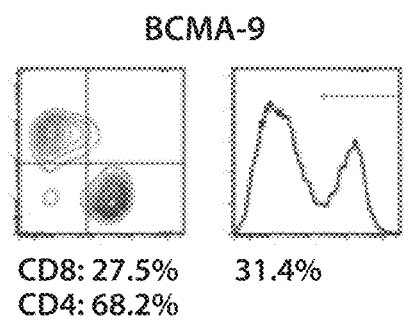
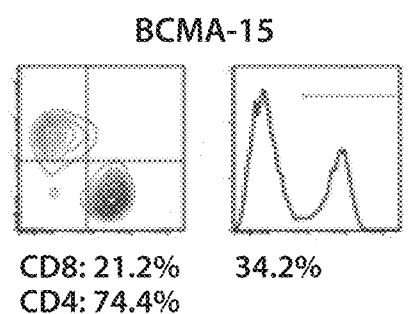
FIG. 20-3

Vector constructs

NUCLEIC ACID ENCODING A HUMANIZED ANTI-BCMA CHIMERIC ANTIGEN RECEPTOR

This application claims priority to PCT Application No. PCT/CN2014/090501, filed Nov. 6, 2014, and PCT Application No. PCT/CN2014/082586, filed Jul. 21, 2014. The entire contents of these applications are incorporated herein by reference.

SEQUENCE LISTING

The instant application contains a Sequence Listing which has been submitted electronically in ASCII format and is hereby incorporated by reference in its entirety. Said ASCII copy, created on Sep. 28, 2015, is named N2067-704510_SL.txt and is 753,712 bytes in size.

FIELD OF THE INVENTION

The present invention relates generally to the use of immune effector cells (e.g., T cells, NK cells) engineered to express a Chimeric Antigen Receptor (CAR) to treat a disease associated with expression of the B-cell maturation antigen protein (BCMA).

BACKGROUND OF THE INVENTION

B-cell maturation antigen (BCMA) is a tumor necrosis family receptor (TNFR) member expressed cells of the B-cell lineage. BCMA expression is the highest on terminally differentiated B cells. BCMA is involved in mediating the survival of plasma cells for mataining long-term humoral immunity. The expression of BCMA has been recently linked to a number of cancers, autoimmune disorders, and infectious diseases. Cancers with increased expression of BCMA include some hematological cancers, such as multiple myeloma, Hodgkin's and non-Hodgkin's lymphoma, various leukemias, and glioblastoma.

SUMMARY OF THE INVENTION

In a first aspect, the invention features an isolated nucleic acid molecule encoding a chimeric antigen receptor (CAR), wherein the CAR comprises an antibody or antibody fragment which includes a human anti-BCMA binding domain or a humanized anti-BCMA binding domain, a transmembrane domain, and an intracellular signaling domain (e.g., an intracellular signaling domain comprising a costimulatory domain and/or a primary signaling domain). In one embodiment, the CAR comprises an antibody or antibody fragment which includes a human anti-BCMA binding domain described herein or a humanized anti-BCMA binding domain, described herein, a transmembrane domain described herein, and an intracellular signaling domain described herein (e.g., an intracellular signaling domain comprising a costimulatory domain and/or a primary signaling domain).

In one embodiment, the encoded BCMA binding domain (e.g., human or humanized anti-BCMA binding domain) comprises one or more (e.g., all three) light chain complementary determining region 1 (LC CDR1), light chain complementary determining region 2 (LC CDR2), and light chain complementary determining region 3 (LC CDR3) of a human or humanized anti-BCMA binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of an anti-BCMA binding domain described herein, e.g., a human or humanized anti-BCMA binding domain comprising one or more, e.g., all three, LC CDRs and one or more, e.g., all three, HC CDRs. In one embodiment, the encoded human anti-BCMA binding domain comprises a light chain variable region described herein (e.g., in Table 8) and/or a heavy chain variable region described herein (e.g., in Table 8). In one embodiment, the encoded humanized anti-BCMA binding domain comprises a light chain variable region provided in SEQ ID NO: 271 or 273 and/or a heavy chain variable region provided in SEQ ID NO: 271 or 273. In one embodiment, the encoded human anti-BCMA binding domain is a scFv comprising a light chain and a heavy chain of an amino acid sequence of—Table 8. In one embodiment, the encoded humanized anti-BCMA binding domain is a scFv comprising a light chain and a heavy chain of an amino acid sequence of SEQ ID NO: 271 or 273. In an embodiment, the human or humanized anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 8 or SEQ ID NO: 271 or 273, or a sequence with 95-99% identity with an amino acid sequence of Table 8 or SEQ ID NO: 271 or 273; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 8 or SEQ ID NO: 271 or 273, or a sequence with 95-99% identity to an amino acid sequence of Table 8. In one embodiment, the encoded human anti-BCMA binding domain comprises a sequence selected from a group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, and SEQ ID NO: 149, or a sequence with 95-99% identity thereof. In one embodiment, the encoded humanized anti-BCMA binding domain comprises a sequence selected from a group consisting of SEQ ID NO: 271 or SEQ ID NO: 273, or a sequence with 95-99% identity thereof. In one embodiment, the encoded human or humanized anti-BCMA binding domain includes a (Gly4-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region.

In other embodiments, the encoded BCMA binding domain comprises a HC CDR1, a HC CDR2, and a HC CDR3 of any BCMA heavy chain binding domain amino acid sequences listed in Tables 8 or 10. In embodiments, the BCMA binding domain further comprises a LC CDR1, a LC CDR2, and a LC CDR3. In embodiments, the BCMA binding domain comprises a LC CDR1, a LC CDR2, and a LC CDR3 of any BCMA light chain binding domain amino acid sequences listed in Tables 8 or 10.

In some embodiments, the encoded BCMA binding domain comprises one, two or all of LC CDR1, LC CDR2, and LC CDR3 of any BCMA light chain binding domain amino acid sequences listed in Tables 8 or 10, and one, two or all of HC CDR1, HC CDR2, and HC CDR3 of any BCMA heavy chain binding domain amino acid sequences listed in Tables 8 or 10.

In one embodiment, the encoded anti-BCMA binding domain comprises a light chain variable region described herein (e.g., in Table 10) and/or a heavy chain variable region described herein (e.g., in Table 10). In one embodiment, the encoded humanized anti-BCMA binding domain comprises a light chain variable region provided in SEQ ID NO: 259, SEQ ID NO: 260, SEQ ID NO: 261, SEQ ID NO: 262, and/or a heavy chain variable region provided in SEQ ID NO: 255, SEQ ID NO: 256, SEQ ID NO: 257, SEQ ID NO: 258. In one embodiment, the encoded anti-BCMA binding domain is a scFv comprising a light chain and a heavy chain of an amino acid sequence of Table 10. In an embodiment, the human or humanized anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in SEQ ID NO: 259, SEQ ID NO: 260, SEQ ID NO: 261, SEQ ID NO: 262, or a sequence with 95-99% identity thereof; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in SEQ ID NO: 255, SEQ ID NO: 256, SEQ ID NO: 257, SEQ ID NO: 258, or a sequence with 95-99% identity thereof. In one embodiment, the encoded anti-BCMA binding domain includes a (Gly4-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region.

In one embodiment, the encoded human anti-BCMA binding domain comprises a sequence selected from a group consisting of SEQ ID NO: 263, SEQ ID NO: 264, SEQ ID NO: 265, and SEQ ID NO: 266, or a sequence with 95-99% identity thereof.

In one embodiment, the encoded CAR includes a transmembrane domain that comprises a transmembrane domain of a protein, e.g., described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the encoded transmembrane domain comprises the sequence of SEQ ID NO: 6. In one embodiment, the encoded transmembrane domain comprises an amino acid sequence comprising at least one, two or three modifications but not more than 20, 10 or 5 modifications of the amino acid sequence of SEQ ID NO:6, or a sequence with 95-99% identity to an amino acid sequence of SEQ ID NO:6. In one embodiment, the nucleic acid sequence encoding the transmembrane domain comprises the sequence of SEQ ID NO: 17, or a sequence with 95-99% identity thereof.

In one embodiment, the encoded anti-BCMA binding domain is connected to the transmembrane domain by a hinge region, e.g., a hinge region described herein. In one embodiment, the encoded hinge region comprises SEQ ID NO:2, or a sequence with 95-99% identity thereof. In one embodiment, the nucleic acid sequence encoding the hinge region comprises the sequence of SEQ ID NO: 13, or a sequence with 95-99% identity thereof.

In one embodiment, the isolated nucleic acid molecule further comprises a sequence encoding a costimulatory domain, e.g., a costimulatory domain described herein. In embodiments, the intracellular signaling domain comprises a costimulatory domain. In embodiments, the intracellular signaling domain comprises a primary signaling domain. In embodiments, the intracellular signaling domain comprises one or more (e.g., one or more, two or more, or three or more) of a costimulatory domain and a primary signaling domain.

In one embodiment, the encoded costimulatory domain is a functional signaling domain obtained from a protein, e.g., described herein, e.g., selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In embodiments, the encoded costimulatory domain comprises 4-1BB, CD27, CD28, or ICOS.

In one embodiment, the encoded costimulatory domain of 4-1BB comprises the amino acid sequence of SEQ ID NO:7. In one embodiment, the encoded costimulatory domain comprises an amino acid sequence having at least one, two or three modifications but not more than 20, 10 or 5 modifications of an amino acid sequence of SEQ ID NO:7, or a sequence with 95-99% identity to an amino acid sequence of SEQ ID NO:7. In one embodiment, the nucleic acid sequence encoding the costimulatory domain comprises the nucleotide sequence of SEQ ID NO:18, or a sequence with 95-99% identity thereof. In another embodiment, the encoded costimulatory domain of CD28 comprises the amino acid sequence of SEQ ID NO:1104. In one embodiment, the encoded costimulatory domain comprises an amino acid sequence having at least one, two or three modifications but not more than 20, 10 or 5 modifications of an amino acid sequence of SEQ ID NO:1104, or a sequence with 95-99% identity to an amino acid sequence of SEQ ID NO:1104. In one embodiment, the nucleic acid sequence encoding the costimulatory domain of CD28 comprises the nucleotide sequence of SEQ ID NO:1105 or a sequence with 95-99% identity thereof. In another embodiment, the encoded costimulatory domain of CD27 comprises the amino acid sequence of SEQ ID NO:8. In one embodiment, the encoded costimulatory domain comprises an amino acid sequence having at least one, two or three modifications but not more than 20, 10 or 5 modifications of an amino acid sequence of SEQ ID NO:8, or a sequence with 95-99% identity to an amino acid sequence of SEQ ID NO:8. In one embodiment, the nucleic acid sequence encoding the costimulatory domain of CD27 comprises the nucleotide sequence of SEQ ID NO:19, or a sequence with 95-99% identity thereof. In another embodiment, the encoded costimulatory domain of ICOS comprises the amino acid sequence of SEQ ID NO:1106. In one embodiment, the encoded costimulatory domain comprises an amino acid sequence having at least one, two or three modifications but not more than 20, 10 or 5 modifications of an amino acid sequence of SEQ ID NO:1106, or a sequence with 95-99% identity to an amino acid sequence of SEQ ID NO:1106. In one embodiment, the nucleic acid sequence encoding the costimulatory domain of ICOS comprises the nucleotide sequence of SEQ ID NO:1107 or a sequence with 95-99% identity thereof.

In embodiments, the encoded primary signaling domain comprises a functional signaling domain of CD3 zeta. In embodiments, the functional signaling domain of CD3 zeta comprises the amino acid sequence of SEQ ID NO: 9 (mutant CD3zeta) or SEQ ID NO: 10 (wild type human CD3zeta), or a sequence with 95-99% identity thereof.

In one embodiment, the encoded intracellular signaling domain comprises a functional signaling domain of 4-1BB and/or a functional signaling domain of CD3 zeta. In one embodiment, the encoded intracellular signaling domain of 4-1BB comprises the amino acid sequence of SEQ ID NO: 7 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:7 and/or an amino acid sequence of SEQ ID NO:9 or SEQ ID NO:10, or a sequence with 95-99% identity to an amino acid sequence of SEQ ID NO:7 and/or an amino acid sequence of SEQ ID NO:9 or SEQ ID NO:10. In one embodiment, the encoded intracellular signaling domain comprises the sequence of SEQ ID NO:7 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of 4-1BB comprises the nucleotide sequence of SEQ ID NO:18, or a sequence with 95-99% identity thereof, and/or the CD3 zeta nucleotide sequence of SEQ ID NO:20 or SEQ ID NO:21, or a sequence with 95-99% identity thereof.

In one embodiment, the encoded intracellular signaling domain comprises a functional signaling domain of CD27 and/or a functional signaling domain of CD3 zeta. In one embodiment, the encoded intracellular signaling domain of CD27 comprises the amino acid sequence of SEQ ID NO: 8 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:8 and/or an amino acid sequence of SEQ ID NO:9 or SEQ ID NO:10, or a sequence with 95-99% identity to an amino acid sequence of SEQ ID NO:8 and/or an amino acid sequence of SEQ ID NO:9 or SEQ ID NO:10. In one embodiment, the encoded intracellular signaling domain comprises the sequence of SEQ ID NO:8 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of CD27 comprises the nucleotide sequence of SEQ ID NO:19, or a sequence with 95-99% identity thereof, and/or the CD3 zeta nucleotide sequence of SEQ ID NO:20 or SEQ ID NO:21, or a sequence with 95-99% identity thereof.

In one embodiment, the encoded intracellular signaling domain comprises a functional signaling domain of CD28 and/or a functional signaling domain of CD3 zeta. In one embodiment, the encoded intracellular signaling domain of CD28 comprises the amino acid sequence of SEQ ID NO: 1104 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:1104 and/or an amino acid sequence of SEQ ID NO:9 or SEQ ID NO:10, or a sequence with 95-99% identity to an amino acid sequence of SEQ ID NO:1104 and/or an amino acid sequence of SEQ ID NO:9 or SEQ ID NO:10. In one embodiment, the encoded intracellular signaling domain comprises the sequence of SEQ ID NO:1104 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of CD28 comprises the nucleotide sequence of SEQ ID NO:1105, or a sequence with 95-99% identity thereof, and/or the CD3 zeta nucleotide sequence of SEQ ID NO:20 or SEQ ID NO:21, or a sequence with 95-99% identity thereof.

In one embodiment, the encoded intracellular signaling domain comprises a functional signaling domain of ICOS and/or a functional signaling domain of CD3 zeta. In one embodiment, the encoded intracellular signaling domain of ICOS comprises the amino acid sequence of SEQ ID NO: 1106 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:1106 and/or an amino acid sequence of SEQ ID NO:9 or SEQ ID NO:10, or a sequence with 95-99% identity to an amino acid sequence of SEQ ID NO:1106 and/or an amino acid sequence of SEQ ID NO:9 or SEQ ID NO:10. In one embodiment, the encoded intracellular signaling domain comprises the sequence of SEQ ID NO:1106 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of ICOS comprises the nucleotide sequence of SEQ ID NO:1107, or a sequence with 95-99% identity thereof, and/or the CD3 zeta nucleotide sequence of SEQ ID NO:20 or SEQ ID NO:21, or a sequence with 95-99% identity thereof.

In another aspect, the invention pertains to an isolated nucleic acid molecule encoding a CAR construct comprising a leader sequence, e.g., a leader sequence described herein, e.g., the amino acid sequence of SEQ ID NO: 1; an anti- BCMA binding domain described herein, e.g., human anti-BCMA binding domain comprising a LC CDR1, a LC CDR2, a LC CDR3, a HC CDR1, a HC CDR2 and a HC CDR3 described herein (e.g., a human anti-BCMA binding domain described in Tables 8 or 10), or a sequence with 95-99% identify thereof; a hinge region described herein, e.g., the amino acid sequence of SEQ ID NO:2; a transmembrane domain described herein, e.g., having a sequence of SEQ ID NO: 6; and an intracellular signaling domain, e.g., an intracellular signaling domain described herein. In one embodiment, the encoded intracellular signaling domain comprises a costimulatory domain, e.g., a costimulatory domain described herein (e.g., a 4-1BB costimulatory domain having the amino acid sequence of SEQ ID NO:7 or a CD27 costimulatory domain having the amino acid sequence of SEQ ID NO:8), and/or a primary signaling domain, e.g., a primary signaling domain described herein, (e.g., a CD3 zeta stimulatory domain having a sequence of SEQ ID NO:9 or SEQ ID NO:10). In one embodiment, the isolated nucleic acid molecule encoding the CAR construct includes a leader sequence encoded by the nucleic acid sequence of SEQ ID NO:1, or a sequence with 95-99% identity thereto.

In another aspect, the invention pertains to an isolated nucleic acid molecule encoding a CAR construct comprising a leader sequence, e.g., a leader sequence described herein, e.g., the amino acid sequence of SEQ ID NO: 1; an anti-BCMA binding domain described herein (e.g., humanized anti-BCMA binding domain comprising a LC CDR1, a LC CDR2, a LC CDR3, a HC CDR1, a HC CDR2 and/or a HC CDR3 described herein, e.g., a humanized anti-BCMA binding domain described herein (e.g., a humanized anti-BCMA binding domain comprising a sequence selected from a group consisting of SEQ ID NO: 271 or SEQ ID NO: 273), or a sequence with 95-99% identify thereof); a hinge region described herein, e.g., the amino acid sequence of SEQ ID NO:2; a transmembrane domain described herein, e.g., having a sequence of SEQ ID NO: 6, and an intracellular signaling domain, e.g., an intracellular signaling domain described herein. In one embodiment, the encoded intracellular signaling domain comprises a costimulatory domain, e.g., a costimulatory domain described herein (e.g., a 4-1BB costimulatory domain having a sequence of SEQ ID NO:7), and/or a primary signaling domain, e.g., a primary signaling domain described herein (e.g., a CD3 zeta stimulatory domain having a sequence of SEQ ID NO:9 or SEQ ID NO:10). In one embodiment, the isolated nucleic acid molecule encoding the CAR construct includes a leader sequence encoded by the nucleic acid sequence of SEQ ID NO:1, or a sequence with 95-99% identity thereto.

In one embodiment, the isolated nucleic acid molecule encoding the CAR construct includes a human anti-BCMA binding domain sequence encoded by the nucleic acid sequence of SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, or SEQ ID NO: 170, or a sequence with 95-99% identity thereto. In one embodiment, the isolated nucleic acid molecule encoding the CAR construct includes a humanized anti-BCMA binding domain sequence encoded by the nucleic acid sequence of SEQ ID NO: 272, SEQ ID NO: 274, or a sequence with 95-99% identity thereto.

In one embodiment, the isolated nucleic acid molecule comprises (e.g., consists of) a nucleic acid encoding a CAR amino acid sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, or SEQ ID NO: 233, or an amino acid sequence having 85%, 90%, 95%, 96%, 97%, 98% or 99% identity to or having one, two or three modifications (e.g., substitutions, e.g., conservative substitutions) but not more than 30, 20 or 10 modifications (e.g., substitutions, e.g., conservative substitutions) of an amino acid sequence of an amino acid sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, or SEQ ID NO: 233.

In one embodiment, the isolated nucleic acid molecule comprises (e.g., consists of) a nucleic acid sequence of SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, or SEQ ID NO: 254, or a nucleic acid sequence having 85%, 90%, 95%, 96%, 97%, 98% or 99% identity to or having one, two or three modifications (e.g., substitutions, e.g., conservative substitutions) but not more than 30, 20 or 10 modifications (e.g., substitutions, e.g., conservative substitutions) of an amino acid sequence of a nucleic acid sequence of SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, or SEQ ID NO: 254.

In one aspect, the invention pertains to an isolated nucleic acid molecule encoding an anti-BCMA binding domain, wherein the anti-BCMA binding domain comprises one or more (e.g., all three) light chain complementary determining region 1 (LC CDR1), light chain complementary determining region 2 (LC CDR2), and/or light chain complementary determining region 3 (LC CDR3) of an anti-BCMA binding domain described herein, and one or more (e.g., all three) heavy chain complementary determining region 1 (HC CDR1), heavy chain complementary determining region 2 (HC CDR2), and/or heavy chain complementary determining region 3 (HC CDR3) of an anti-BCMA binding domain described herein, e.g., a human anti-BCMA binding domain comprising one or more, e.g., all three, LC CDRs and one or more, e.g., all three, HC CDRs. In one embodiment, the encoded anti-BCMA binding domain comprises a light chain variable region described herein (e.g., in SEQ ID NO: 84, 85, 86, 87, 88, 89, 90, 91, 92, 93, 94, 95, 96, 97, 98, 192, 193, 194, 195, 196, 197, 198, 199, 200, 201, 202, 203, 204, 205, 206, 207, 208, 209, 210, 211, 212, 259, 260, 261, or 262) and/or a heavy chain variable region described herein (e.g., in SEQ ID NO: 69, 70, 71, 72, 73, 74, 75, 76, 77, 78, 79, 81, 82, 83, 171, 172, 173, 174, 175, 176, 177, 178, 179, 180, 181, 182, 183, 184, 185, 186, 187, 188, 189, 190, 191, 255, 256, 257, or 258). In one embodiment, the encoded anti-BCMA binding domain is a scFv comprising a light chain and a heavy chain of an amino acid sequence of in SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, or SEQ ID NO: 266, or a sequence with 95-99% identity thereof. In an embodiment, the anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in SEQ ID NO: 84, 85, 86, 87, 88, 89, 90, 91, 92, 93, 94, 95, 96, 97, 98, 192, 193, 194, 195, 196, 197, 198, 199, 200, 201, 202, 203, 204, 205, 206, 207, 208, 209, 210, 211, 212, 259, 260, 261, or 262 or a sequence with 95-99% identity with an amino acid sequence of SEQ ID NO: 84, 85, 86, 87, 88, 89, 90, 91, 92, 93, 94, 95, 96, 97, 98, 192, 193, 194, 195, 196, 197, 198, 199, 200, 201, 202, 203, 204, 205, 206, 207, 208, 209, 210, 211, 212, 259, 260, 261, or 262; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in SEQ ID NO: 69, 70, 71, 72, 73, 74, 75, 76, 77, 78, 79, 81, 82, 83, 171, 172, 173, 174, 175, 176, 177, 178, 179, 180, 181, 182, 183, 184, 185, 186, 187, 188, 189, 190, 191, 255, 256, 257, or 258 or a sequence with 95-99% identity to an amino acid sequence in SEQ ID NO: 69, 70, 71, 72, 73, 74, 75, 76, 77, 78, 79, 81, 82, 83, 171, 172, 173, 174, 175, 176, 177, 178, 179, 180, 181, 182, 183, 184, 185, 186, 187, 188, 189, 190, 191, 255, 256, 257, or 258. In one embodiment, the anti-BCMA binding domain comprises a sequence selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, and SEQ ID NO: 149, SEQ ID NO: 263, SEQ ID NO: 264, SEQ ID NO: 265, or SEQ ID NO: 266, or a sequence with 95-99% identify thereof. In one embodiment, the encoded anti-BCMA binding domain is a scFv, and a light chain variable region comprising an amino acid sequence described herein, e.g., in Tables 8 or 10, is attached to a heavy chain variable region comprising an amino acid sequence described herein, e.g., in Tables 8 or 10, via a linker, e.g., a linker described herein. In one embodiment, the encoded anti-BCMA binding domain includes a (Gly$_4$-Ser)n linker, wherein n is 1, 2, 3, 4, 5, or 6, preferably 4 (SEQ ID NO: 26). The light chain variable region and heavy chain variable region of a scFv can be, e.g., in any of the following orientations: light chain variable region-linker-heavy chain variable region or heavy chain variable region-linker-light chain variable region. In one embodiment, the isolated nucleic acid sequence encoding the human anti-BCMA binding domain comprises a sequence selected from a group consisting of SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, and SEQ ID NO: 170, or a sequence with 95-99% identity thereof.

In other embodiments, the encoded BCMA binding domain comprises a HC CDR1, a HC CDR2, and a HC CDR3 of any BCMA heavy chain binding domain amino acid sequences listed in Tables 8 or 10. In embodiments, the BCMA binding domain further comprises a LC CDR1, a LC CDR2, and a LC CDR3. In embodiments, the BCMA binding domain comprises a LC CDR1, a LC CDR2, and a LC CDR3 of any BCMA light chain binding domain amino acid sequences listed in Tables 8 or 10.

In some embodiments, the encoded BCMA binding domain comprises one, two or all of LC CDR1, LC CDR2, and LC CDR3 of any BCMA light chain binding domain amino acid sequences listed in Tables 8 or 10, and one, two or all of HC CDR1, HC CDR2, and HC CDR3 of any BCMA heavy chain binding domain amino acid sequences listed in Tables 8 or 10.

In an embodiment, the anti-BCMA binding domain (e.g., an scFv) comprises: a light chain variable region comprising an amino acid sequence comprising (or consisting of) a light chain variable region of SEQ ID NO: 271 or 273; and amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in SEQ ID NO: 271 or 273, or a sequence with 95-99% identify thereof; and/or a heavy chain variable region comprising an amino acid sequence comprising (or consisting of) a heavy chain variable region of SEQ ID NO: 271 or 273; and amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in SEQ ID NO: 271 or 273, or a sequence with 95-99% identify thereof. In one embodiment, the encoded humanized anti-BCMA binding domain is a scFv, and a light chain variable region comprising an amino acid sequence described herein, e.g., provided in SEQ ID NO: 271 or 273, is attached to a heavy chain variable region comprising an amino acid sequence described herein, e.g., provided in SEQ ID NO: 271 or 273, via a linker, e.g., a linker described herein. In one embodiment, the encoded anti-BCMA binding domain includes a (Gly$_4$-Ser)n linker, wherein n is 1, 2, 3, 4, 5, or 6, preferably 4 (SEQ ID NO: 26).

In another aspect, the invention pertains to an isolated polypeptide molecule, e.g., isolated chimeric antigen receptor (CAR) molecule, encoded by the nucleic acid molecule. In one embodiment, the isolated polypeptide molecule comprises a sequence selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, and SEQ ID NO: 233, or a sequence with 95-99% identify thereof.

In another aspect, the invention pertains to an isolated chimeric antigen receptor (CAR) molecule (e.g., polypeptide) comprising an anti-BCMA binding domain (e.g., a human or humanized antibody or antibody fragment that specifically binds to BCMA), a transmembrane domain, and an intracellular signaling domain (e.g., an intracellular signaling domain comprising a costimulatory domain and/or a primary signaling domain). In one embodiment, the CAR comprises an antibody or antibody fragment which includes an anti-BCMA binding domain described herein (e.g., a human antibody or antibody fragment that specifically binds to BCMA as described herein), a transmembrane domain described herein, and an intracellular signaling domain described herein (e.g., an intracellular signaling domain comprising a costimulatory domain and/or a primary signaling domain described herein).

In one embodiment, the anti-BCMA binding domain comprises one or more (e.g., all three) light chain complementary determining region 1 (LC CDR1), light chain complementary determining region 2 (LC CDR2), and light chain complementary determining region 3 (LC CDR3) of an anti-BCMA binding domain described herein, and one or more (e.g., all three) heavy chain complementary determining region 1 (HC CDR1), heavy chain complementary determining region 2 (HC CDR2), and heavy chain complementary determining region 3 (HC CDR3) of an anti-BCMA binding domain described herein, e.g., a human or humanized anti-BCMA binding domain comprising one or more, e.g., all three, LC CDRs and one or more, e.g., all three, HC CDRs. In one embodiment, the anti-BCMA binding domain comprises a light chain variable region described herein (e.g., in Table 8 or SEQ ID NO: 271 or 273) and/or a heavy chain variable region described herein (e.g., in Table 8 or SEQ ID NO: 271 or 273). In one embodiment, the anti-BCMA binding domain is a scFv comprising a light chain and a heavy chain of an amino acid sequence listed in Table 8, SEQ ID NO: 271 or 273. In an embodiment, the anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 8 or SEQ ID NO: 271 or 273, or a sequence with 95-99% identity with an amino acid sequence provided in Table 8 or SEQ ID NO: 271 or 273; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 8 or SEQ ID NO: 271 or 273, or a sequence with 95-99% identity to an amino acid sequence provided in Table 8 or SEQ ID NO: 271 or 273. In one embodiment, the anti-BCMA binding domain comprises a sequence selected from a group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, or SEQ ID NO: 266; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identify to any of the aforesaid sequences. In one embodiment, the anti-BCMA binding domain comprises a sequence selected from a group consisting of SEQ ID NO: 271 or SEQ ID NO: 273, or a sequence with 95-99% identify thereof. In one embodiment, the anti-BCMA binding domain is a scFv, and a light chain variable region comprising an amino acid sequence described herein, e.g., in Tables 8 or 10, SEQ ID NO: 271 or SEQ ID NO: 273, is attached to a heavy chain variable region comprising an amino acid sequence described herein, e.g., in Tables 8 or 10, SEQ ID NO: 271 or SEQ ID NO: 273, via a linker, e.g., a linker described herein. In one embodiment, the anti-BCMA binding domain includes a (Gly$_4$-Ser)n linker, wherein n is 1, 2, 3, 4, 5, or 6, preferably 4 (SEQ ID NO: 26). The light chain variable region and heavy chain variable region of a scFv can be, e.g., in any of the following orientations: light chain variable region-linker-heavy chain variable region or heavy chain variable region-linker-light chain variable region.

In other embodiments, the BCMA binding domain comprises a HC CDR1, a HC CDR2, and a HC CDR3 of any BCMA heavy chain binding domain amino acid sequences listed in Tables 8 or 10. In embodiments, the BCMA binding domain further comprises a LC CDR1, a LC CDR2, and a LC CDR3. In embodiments, the BCMA binding domain comprises a LC CDR1, a LC CDR2, and a LC CDR3 of any BCMA light chain binding domain amino acid sequences listed in Tables 8 or 10.

In some embodiments, the BCMA binding domain comprises one, two or all of LC CDR1, LC CDR2, and LC CDR3 of any BCMA light chain binding domain amino acid sequences listed in Tables 8 or 10, and one, two or all of HC CDR1, HC CDR2, and HC CDR3 of any BCMA heavy chain binding domain amino acid sequences listed in Tables 8 or 10.

In one embodiment, the isolated CAR molecule comprises a transmembrane domain of a protein, e.g., described herein, e.g., selected from the group consisting of the the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the transmembrane domain comprises a sequence of SEQ ID NO: 6. In one embodiment, the transmembrane domain comprises an amino acid sequence having at least one, two or three modifications (e.g., substitutions, e.g., conservative substitutions) but not more than 20, 10 or 5 modifications (e.g., substitutions, e.g., conservative substitutions) of an amino acid sequence of SEQ ID NO: 6, or a sequence with 95-99% identity to an amino acid sequence of SEQ ID NO: 6.

In one embodiment, the anti-BCMA binding domain is connected to the transmembrane domain by a hinge region, e.g., a hinge region described herein. In one embodiment, the encoded hinge region comprises SEQ ID NO:2, or a sequence with 95-99% identity thereof.

In one embodiment, the isolated CAR molecule further comprises a sequence encoding a costimulatory domain, e.g., a costimulatory domain described herein. In embodiments, the intracellular signaling domain of the isolated CAR molecule comprises a costimulatory domain. In embodiments, the intracellular signaling domain of the isolated CAR molecule comprises a primary signaling domain. In embodiments, the intracellular signaling domain of the isolated CAR molecule comprises a costimulatory domain and a primary signaling domain.

In one embodiment, the costimulatory domain comprises a functional signaling domain of a protein selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In one embodiment, the costimulatory domain comprises a sequence of SEQ ID NO:7. In one embodiment, the costimulatory domain comprises an amino acid sequence having at least one, two or three modifications (e.g., substitutions, e.g., conservative substitutions) but not more than 20, 10 or 5 modifications (e.g., substitutions, e.g., conservative substitutions) of an amino acid sequence of SEQ ID NO:7, or a sequence with 95-99% identity to an amino acid sequence of SEQ ID NO:7. In another embodiment, the costimulatory domain of CD28 comprises the amino acid sequence of SEQ ID NO:1104. In one embodiment, the costimulatory domain comprises an amino acid sequence having at least one, two or three modifications but not more than 20, 10 or 5 modifications of an amino acid sequence of SEQ ID NO:1104, or a sequence with 95-99% identity to an amino acid sequence of SEQ ID NO:1104. In another embodiment, the costimulatory domain of CD27 comprises the amino acid sequence of SEQ ID NO:8. In one embodiment, the costimulatory domain comprises an amino acid sequence having at least one, two or three modifications but not more than 20, 10 or 5 modifications of an amino acid sequence of SEQ ID NO:8, or a sequence with 95-99% identity to an amino acid sequence of SEQ ID NO:8. In another embodiment, the costimulatory domain of ICOS comprises the amino acid sequence of SEQ ID NO:1106. In one embodiment, the costimulatory domain comprises an amino acid sequence having at least one, two or three modifications but not more than 20, 10 or 5 modifications of an amino acid sequence of SEQ ID NO:1106, or a sequence with 95-99% identity to an amino acid sequence of SEQ ID NO:1106.

In embodiments, the primrary signaling domain comprises a signaling domain or CD3 zeta. In embodiments, the functional dignaling domain of CD3 zeta comprises SEQ ID NO: 9 (mutant CD3 zeta) or SEQ ID NO: 10 (wild type human CD3 zeta), or a sequence with 95-99% identity thereof.

In one embodiment, the intracellular signaling domain comprises a functional signaling domain of 4-1BB and/or a functional signaling domain of CD3 zeta. In one embodiment, the intracellular signaling domain comprises the sequence of SEQ ID NO: 7 and/or the sequence of SEQ ID NO:9 or SEQ ID NO:10. In one embodiment, the intracellular signaling domain comprises an amino acid sequence having at least one, two or three modifications (e.g., substitutions, e.g., conservative substitutions) but not more than 20, 10 or 5 modifications (e.g., substitutions, e.g., conservative substitutions) of an amino acid sequence of SEQ ID NO: 7 and/or the sequence of SEQ ID NO:9 or SEQ ID NO:10, or a sequence with 95-99% identity to an amino acid sequence of SEQ ID NO: 7 and/or the sequence of SEQ ID NO:9 or SEQ ID NO:10. In one embodiment, the intracellular signaling domain comprises the sequence of SEQ ID NO: 7 and/or the sequence of SEQ ID NO:9 or SEQ ID NO:10, wherein the sequences comprising the intracellular signaling domain are expressed in the same frame and as a single polypeptide chain.

In one embodiment, the intracellular signaling domain comprises a functional signaling domain of CD27 and/or a functional signaling domain of CD3 zeta. In one embodiment, the intracellular signaling domain of CD27 comprises the amino acid sequence of SEQ ID NO: 8 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:8 and/or an amino acid sequence of SEQ ID NO:9 or SEQ ID NO:10, or a sequence with 95-99% identity to an amino acid sequence of SEQ ID NO:8 and/or an amino acid sequence of SEQ ID NO:9 or SEQ ID NO:10. In one embodiment, the intracellular signaling domain comprises the sequence of SEQ ID NO:8 and the sequence of SEQ ID NO:9 or SEQ ID NO:10, wherein the sequences comprising the intracellular signaling domain are expressed in the same frame and as a single polypeptide chain.

In one embodiment, the intracellular signaling domain comprises a functional signaling domain of CD28 and/or a functional signaling domain of CD3 zeta. In one embodiment, the encoded intracellular signaling domain of CD28 comprises the amino acid sequence of SEQ ID NO: 1104 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO: 1104 and/or an amino acid sequence of SEQ ID NO:9 or SEQ ID NO:10, or a sequence with 95-99% identity to an amino acid sequence of SEQ ID NO: 379 and/or an amino acid sequence of SEQ ID NO:9 or SEQ ID NO:10. In one embodiment, the intracellular signaling domain comprises the sequence of SEQ ID NO: 1104 and the sequence of SEQ ID NO:9 or SEQ ID NO:10, wherein the sequences comprising the intracellular signaling domain are expressed in the same frame and as a single polypeptide chain.

In one embodiment, the intracellular signaling domain comprises a functional signaling domain of ICOS and/or a functional signaling domain of CD3 zeta. In one embodiment, the intracellular signaling domain of ICOS comprises the amino acid sequence of SEQ ID NO: 1106 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:1106 and/or an amino acid sequence of SEQ ID NO:9 or SEQ ID NO:10, or a sequence with 95-99% identity to an amino acid sequence of SEQ ID NO:1106 and/or an amino acid sequence of SEQ ID NO:9 or SEQ ID NO:10. In one embodiment, the encoded intracellular signaling domain comprises the sequence of SEQ ID NO:1106 and the sequence of SEQ ID NO:9 or SEQ ID NO:10, wherein the sequences comprising the intracellular signaling domain are expressed in the same frame and as a single polypeptide chain.

In one embodiment, the isolated CAR molecule further comprises a leader sequence, e.g., a leader sequence described herein. In one embodiment, the leader sequence comprises an amino acid sequence of SEQ ID NO: 1, or a sequence with 95-99% identity to an amino acid sequence of SEQ ID NO:1

In another aspect, the invention pertains to an isolated CAR molecule comprising a leader sequence, e.g., a leader sequence described herein, e.g., a leader sequence of SEQ ID NO: 1, or having 95-99% identity thereof, an anti-BCMA binding domain described herein, e.g., an anti-BCMA binding domain comprising a LC CDR1, a LC CDR2, a LC CDR3, a HC CDR1, a HC CDR2 and a HC CDR3 described herein, e.g., an anti-BCMA binding domain described in Tables 8 or 10, SEQ ID NO: 271 or SEQ ID NO: 273, or a sequence with 95-99% identify thereof, a hinge region, e.g., a hinge region described herein, e.g., a hinge region of SEQ ID NO:2, or having 95-99% identity thereof, a transmembrane domain, e.g., a transmembrane domain described herein, e.g., a transmembrane domain having a sequence of SEQ ID NO: 6 or a sequence having 95-99% identity thereof, an intracellular signaling domain, e.g., an intracellular signaling domain described herein (e.g., an intracellular signaling domain comprising a costimulatory domain and/or a primary signaling domain). In one embodiment, the intracellular signaling domain comprises a costimulatory domain, e.g., a costimulatory domain described herein, e.g., a 4-1BB costimulatory domain having a sequence of SEQ ID NO:7, or having 95-99% identity thereof, and/or a primary signaling domain, e.g., a primary signaling domain described herein, e.g., a CD3 zeta stimulatory domain having a sequence of SEQ ID NO:9 or SEQ ID NO:10, or having 95-99% identity thereof. In one embodiment, the intracellular signaling domain comprises a costimulatory domain, e.g., a costimulatory domain described herein, e.g., a 4-1BB costimulatory domain having a sequence of SEQ ID NO:7, and/or a primary signaling domain, e.g., a primary signaling domain described herein, e.g., a CD3 zeta stimulatory domain having a sequence of SEQ ID NO:9 or SEQ ID NO:10.

In one embodiment, the isolated CAR molecule comprises (e.g., consists of) an amino acid sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, or SEQ ID NO: 233, or an amino acid sequence having at least one, two, three, four, five, 10, 15, 20 or 30 modifications (e.g., substitutions, e.g., conservative substitutions) but not more than 60, 50 or 40 modifications (e.g., substitutions, e.g., conservative substitutions) of an amino acid sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, or SEQ ID NO: 233, or an amino acid sequence having 85%, 90%, 95%, 96%, 97%, 98% or 99% identity to an amino acid sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, or SEQ ID NO: 233.

In other embodiments, the anti-BCMA binding domain comprises a HC CDR1, a HC CDR2, and a HC CDR3 of any BCMA heavy chain binding domain amino acid sequences listed in Tables 8 or 10. In embodiments, the BCMA binding domain further comprises a LC CDR1, a LC CDR2, and a LC CDR3. In embodiments, the BCMA binding domain comprises a LC CDR1, a LC CDR2, and a LC CDR3 of any BCMA light chain binding domain amino acid sequences listed in Tables 8 or 10.

In some embodiments, the anti-BCMA binding domain comprises one, two or all of LC CDR1, LC CDR2, and LC CDR3 of any BCMA light chain binding domain amino acid sequences listed in Tables 8 or 10, and one, two or all of HC CDR1, HC CDR2, and HC CDR3 of any BCMA heavy chain binding domain amino acid sequences listed in Tables 8 or 10.

In one aspect, the invention pertains to a BCMA binding domain comprising one or more (e.g., all three) light chain complementary determining region 1 (LC CDR1), light chain complementary determining region 2 (LC CDR2), and light chain complementary determining region 3 (LC CDR3) of a BCMA binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a BCMA binding domain described herein, e.g., a BCMA binding domain comprising one or more, e.g., all three, LC CDRs and one or more, e.g., all three, HC CDRs.

In other embodiments, the BCMA binding domain comprises a HC CDR1, a HC CDR2, and a HC CDR3 of any BCMA heavy chain binding domain amino acid sequences listed in Tables 8 or 10. In embodiments, the BCMA binding domain further comprises a LC CDR1, a LC CDR2, and a LC CDR3. In embodiments, the BCMA binding domain comprises a LC CDR1, a LC CDR2, and a LC CDR3 of any BCMA light chain binding domain amino acid sequences listed in Tables 8 or 10.

In some embodiments, the BCMA binding domain comprises one, two or all of LC CDR1, LC CDR2, and LC CDR3 of any BCMA light chain binding domain amino acid sequences listed in Tables 8 or 10, and one, two or all of HC CDR1, HC CDR2, and HC CDR3 of any BCMA heavy chain binding domain amino acid sequences listed in Tables 8 or 10.

In one embodiment, the BCMA binding domain comprises one or more (e.g., all three) light chain complementary determining region 1 (LC CDR1), light chain complementary determining region 2 (LC CDR2), and light chain complementary determining region 3 (LC CDR3) of an BCMA binding domain described herein, and one or more (e.g., all three) heavy chain complementary determining region 1 (HC CDR1), heavy chain complementary determining region 2 (HC CDR2), and heavy chain complementary determining region 3 (HC CDR3) of an BCMA binding domain described herein, e.g., a human or humanized anti-BCMA binding domain comprising one or more, e.g., all three, LC CDRs and one or more, e.g., all three, HC CDRs. In one embodiment, the BCMA binding domain comprises a light chain variable region described herein (e.g., in Table 8 or SEQ ID NO: 271 or 273) and/or a heavy chain variable region described herein (e.g., in Table 8 or SEQ ID NO: 271 or 273). In one embodiment, the BCMA binding domain is a scFv comprising a light chain and a heavy chain of an amino acid sequence listed in Table 8, SEQ ID NO: 271 or 273. In an embodiment, the BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 8 or SEQ ID NO: 271 or 273, or a sequence with 95-99% identity with an amino acid sequence provided in Table 8 or SEQ ID NO: 271 or 273; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 8 or SEQ ID NO: 271 or 273, or a sequence with 95-99% identity to an amino acid sequence provided in Table 8 or SEQ ID NO: 271 or 273. In one embodiment, the BCMA binding domain comprises a sequence selected from a group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, or SEQ ID NO: 266; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identify to any of the aforesaid sequences. In one embodiment, the BCMA binding domain comprises a sequence selected from a group consisting of SEQ ID NO: 271 or SEQ ID NO: 273, or a sequence with 95-99% identify thereof. In one embodiment, the anti-BCMA binding domain is a scFv, and a light chain variable region comprising an amino acid sequence described herein, e.g., in Tables 8 and 10, SEQ ID NO: 271 or SEQ ID NO: 273, is attached to a heavy chain variable region comprising an amino acid sequence described herein, e.g., in Tables 8 or 10, SEQ ID NO: 271 or SEQ ID NO: 273, via a linker, e.g., a linker described herein. In one embodiment, the BCMA binding domain includes a (Gly$_4$-Ser)n linker, wherein n is 1, 2, 3, 4, 5, or 6, preferably 4 (SEQ ID NO: 26). The light chain variable region and heavy chain variable region of a scFv can be, e.g., in any of the following orientations: light chain variable region-linker-heavy chain variable region or heavy chain variable region-linker-light chain variable region.

In another aspect, the invention pertains to a vector comprising a nucleic acid molecule described herein, e.g., a nucleic acid molecule encoding a CAR described herein. In one embodiment, the vector is selected from the group consisting of a DNA, a RNA, a plasmid, a lentivirus vector, adenoviral vector, or a retrovirus vector.

In one embodiment, the vector is a lentivirus vector. In one embodiment, the vector further comprises a promoter. In one embodiment, the promoter is an EF-1 promoter. In one embodiment, the EF-1 promoter comprises a sequence of SEQ ID NO: 11. In another embodiment, the promoter is a PGK promoter, e.g., a truncated PGK promoter as described herein.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail described herein, e.g., comprising about 150 adenosine bases (SEQ ID NO: 382). In one embodiment, the nucleic acid sequence in the vector further comprises a 3'UTR, e.g., a 3' UTR described herein, e.g., comprising at least one repeat of a 3'UTR derived from human beta-globulin. In one embodiment, the nucleic acid sequence in the vector further comprises promoter, e.g., a T2A promoter.

In another aspect, the invention pertains to a cell comprising a vector described herein. In one embodiment, the cell is a cell described herein, e.g., an immune effector cell, e.g., a human T cell or a human NK cell, e.g., a human T cell described herein or a human NK cell described herein. In one embodiment, the human T cell is a CD8+ T cell.

In another embodiment, the CAR-expressing cell described herein can further express another agent, e.g., an agent which enhances the activity of a CAR-expressing cell. For example, in one embodiment, the agent can be an agent which inhibits an inhibitory molecule. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. In embodiments, the agent is an agent that inhibits PD1. In embodiments, the agent is an agent that inhibits PD-L1. In one embodiment, the agent which inhibits an inhibitory molecule can be an agent described herein, such as, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, LAG3, CEACAM (e.g., CEACAM-1, CEACAM-3 and/or CEACAM-5), CTLA4, VISTA, CD160, BTLA, LAIR1, TIM3, 2B4, TGFR beta, CD80, CD86, B7-H3 (CD276), B7-H4 (VTCN1), HVEM (TNFRSF14 or CD270), KIR, A2aR, MHC class I, MHC class II, GAL9, adenosine, and TIGIT, or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In another aspect, the invention pertains to a method of making a cell comprising transducing a cell described herein, e.g., an immune effector cell described herein, e.g., a T cell or NK cell described herein, with a vector of comprising a nucleic acid encoding a CAR, e.g., a CAR described herein.

The present invention also provides a method of generating a population of RNA-engineered cells, e.g., cells described herein, e.g., immune effector cells, e.g., T cells or NK cells, transiently expressing exogenous RNA. The method comprises introducing an in vitro transcribed RNA or synthetic RNA into a cell, where the RNA comprises a nucleic acid encoding a CAR molecule described herein.

In another aspect, the invention pertains to a method of providing an anti-tumor immunity in a mammal comprising administering to the mammal an effective amount of a cell expressing a CAR molecule, e.g., a cell expressing a CAR molecule described herein. In one embodiment, the cell is an autologous immune effector cell, e.g., T cell or an autologous NK cell. In one embodiment, the cell is an immune effector cell, e.g., allogeneic T cell or an allogeneic NK cell. In one embodiment, the mammal is a human, e.g., a patient with a hematologic cancer.

In another aspect, the invention pertains to a method of treating a mammal having a disease associated with expression of BCMA (e.g., a proliferative disease, a precancerous condition, and a noncancer related indication associated with the expression of BCMA) comprising administering to the mammal an effective amount of the cells expressing a CAR molecule, e.g., a CAR molecule described herein. In one embodiment, the mammal is a human, e.g., a patient with a hematologic cancer.

In one embodiment, the disease is a disease described herein. In one embodiment, the disease associated with BCMA expression is selected from a hematologic cancer such as acute leukemias including but not limited to acute myeloid leukemia (AML); myelodysplastic syndrome; myeloproliferative neoplasms; chronic myeloid leukemia (CML); Blastic plasmacytoid dendritic cell neoplasm; and to disease associated with BCMA expression including, but not limited to atypical and/or non-classical cancers, malignancies, precancerous conditions or proliferative diseases expressing BCMA; and combinations thereof. In one embodiment, the disease associated with BCMA expression is a hematologic cancer selected from the group consisting of one or more acute leukemias including but not limited to B-cell acute lymphoid leukemia ("BALL"), T-cell acute lymphoid leukemia ("TALL"), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with BCMA expression include, but not limited to atypical and/or non-classical cancers, malignancies, precancerous conditions or proliferative diseases expressing BCMA; and combinations thereof.

In embodiments, a disease associated with expression of BCMA includes a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

In embodiments, a disease associated with expression of BCMA includes a cancer, e.g., a cancer described herein, e.g., a prostate cancer (e.g., castrate-resistant or therapy-resistant prostate cancer, or metastatic prostate cancer), pancreatic cancer, or lung cancer.

In one embodiment of the therapeutic methods, the cell expressing a CAR molecule described herein (e.g., a BCMA CAR molecule) is administered in combination with a cell comprising a CD19 CAR molecule. In one embodiment, the cell expressing the BCMA CAR molecule is administered before, subsequent to, or simultaneously with administration of the cell expressing the CD19 CAR. In one embodiment, the cell expressing the BCMA CAR molecule and the cell expressing the CD19 CAR molecule are part of a single composition, and in other embodiments the cell expressing the BCMA CAR molecule and the cell expressing the CD19 CAR molecule are part of separate compositions. In one embodiment, the cell expressing a CAR molecule described herein (e.g., a BCMA CAR molecule) also express a CD19 CAR molecule. In one embodiment, the disease associated with BCMA is multiple myeloma, e.g., CD19-negative multiple myeloma. In one embodiment, the disease associated with expression of BCMA is multiple myeloma e.g., a multiple myeloma that is CD19-negative, e.g., having a vast majority (e.g., 99.95%) of the neoplastic plasma cells with a CD19-negative phenotype, e.g., as detected by both flow cytometry and RT-PCR.

In one embodiment, the cells expressing a CAR molecule, e.g., a CAR molecule described herein, are administered in combination with an agent that increases the efficacy of a cell expressing a CAR molecule, e.g., an agent described herein.

In one embodiment, the cells expressing a CAR molecule, e.g., a CAR molecule described herein, are administered in combination with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive immune effector cells, e.g., T cells or NK cells, or an increase in PD-1 negative cells. PD-1 positive immune effector cells, e.g., T cells or NK cells, but not PD-1 negative immune effector cells (e.g., T cells or NK cells), can be exhausted by engagement with cells which express a PD-1 ligand, e.g., PD-L1 or PD-L2.

In an embodiment this approach can be used to optimize the performance of CAR cells described herein in the subject. While not wishing to be bound by theory, it is believed that, in an embodiment, the performance of endogenous, non-modified immune effector cells, e.g., T cells or NK cells, is improved. While not wishing to be bound by theory, it is believed that, in an embodiment, the performance of a BCMA CAR expressing cell is improved. In other embodiments, cells, e.g., immune effector cells (e.g., T cells or NK cells), which have, or will be engineered to express a CAR, can be treated ex vivo by contact with an amount of an mTOR inhibitor that increases the number of PD1 negative immune effector cells, e.g., T cells or NK cells, or increases the ratio of PD1 negative immune effector cells, e.g., T cells or NK cells/PD1 positive immune effector cells, e.g., T cells or NK cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., immune effector cells (e.g., T cells or NK cells). In an embodiment, the CAR cells are administered after a sufficient time, or sufficient dosing, of an mTOR inhibitor, such that the level of PD1 negative immune effector cells, e.g., T cells or NK cells, or the ratio of PD1 negative immune effector cells, e.g., T cells or NK cells/PD1 positive immune effector cells, e.g., T cells or NK cells, has been, at least transiently, increased.

In an embodiment, the cell, e.g., immune effector cell (e.g., T cell or NK cell), to be engineered to express a CAR, is harvested after a sufficient time, or after sufficient dosing of the low, immune enhancing, dose of an mTOR inhibitor, such that the level of PD1 negative immune effector cells, e.g., T cells or NK cells, or the ratio of PD1 negative immune effector cells, e.g., T cells or NK cells/PD1 positive immune effector cells, e.g., T cells or NK cells, in the subject or harvested from the subject has been, at least transiently, increased.

In an embodiment, the invention provides an mTOR inhibitor for use in the treatment of a subject, wherein said mTOR inhibitor enhances an immune response of said subject, and wherein said subject has received, is receiving or is about to receive an immune effector cell that expresses a BCMA CAR as described herein. In one embodiment, the cells expressing a CAR molecule, e.g., a CAR molecule described herein, are administered in combination with an agent that ameliorates one or more side effect associated with administration of a cell expressing a CAR molecule, e.g., an agent described herein.

In one embodiment, the cells expressing a CAR molecule, e.g., a CAR molecule described herein, are administered in combination with an agent that treats the disease associated with BCMA, e.g., an agent described herein.

In certain embodiments, the disease associated with BCMA is a proliferative disease such as a cancer or malignancy or a precancerous condition such as a myelodysplasia, a myelodysplastic syndrome or a preleukemia, or is a non-cancer related indication associated with expression of BCMA.

In certain embodiments, the disease associated with BCMA is a hematologic cancer selected from the group consisting of one or more acute leukemias including but not limited to acute myeloid leukemia (AML); myelodysplastic syndrome; myeloproliferative neoplasms; chronic myeloid leukemia (CML); Blastic plasmacytoid dendritic cell neoplasm; multiple myeloma; and to disease associated with BMCA expression including, but not limited to atypical and/or non-classical cancers, malignancies, precancerous conditions or proliferative diseases expressing BCMA; and combinations thereof. In one embodiment, the disease associated with BCMA is multiple myeloma. In embodiments, a disease associated with expression of BCMA includes a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome). In embodiments, a disease associated with expression of BCMA includes a cancer, e.g., a cancer described herein, e.g., a prostate cancer (e.g., castrate-resistant or therapy-resistant prostate cancer, or metastatic prostate cancer), pancreatic cancer, or lung cancer.

In embodiments, a BCMA CAR-expressing cell, e.g., a BCMA CAR-expressing cell described herein, is used to treat a subject having multiple myeloma. In embodiments, a BCMA CAR-expressing cell, e.g., BCMA CAR-expressing cell described herein, is used to treat a subject having a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome). In embodiments, a BCMA CAR-expressing cell, e.g., BCMA CAR-expressing cell described herein, is used to treat a subject having a cancer, e.g., a cancer described herein, e.g., a prostate cancer (e.g., castrate-resistant or therapy-resistant prostate cancer, or metastatic prostate cancer), pancreatic cancer, or lung cancer.

In embodiments, a BCMA CAR-expressing cell, e.g., a BCMA CAR-expressing cell described herein, is administered to the subject according to a dosing regimen comprising a total dose of cells administered to the subject by dose fractionation, e.g., one, two, three or more separate administration of a partial dose. In embodiments, a first percentage of the total dose is administered on a first day of treatment, a second percentage of the total dose is administered on a subsequent (e.g., second, third, fourth, fifth, sixth, or seventh or later) day of treatment, and optionally, a third percentage (e.g., the remaining percentage) of the total dose is administered on a yet subsequent (e.g., third, fourth, fifth, sixth, seventh, eighth, ninth, tenth, or later) day of treatment. For example, 10% of the total dose of cells is delivered on the first day, 30% of the total dose of cells is delivered on the second day, and the remaining 60% of the total dose of cells is delivered on the third day of treatment. For example, a total cell dose includes 1 to $5 \times 10^7$ or 1 to $5 \times 10^8$ BCMA-CART cells.

In embodiments, a lympho-depleting therapy (e.g., Cytoxan, e.g., at 1.5 g/m$^2$) is administered to the subject before CAR-expressing cell administration. In embodiments, no lympho-depleting therapy (e.g., cytoxan) is administered to the subject before CAR-expressing cell administration.

In embodiments, no lympho-depleting chemotherapy is administered, and a total BCMA-CART cell dose of 1 to $5 \times 10^7$ is administered (e.g., by infusion) with 10% of the cell dose on day 1 of treatment, 30% on day 2 of treatment, and 60% on day 3 of treatment. In another embodiment, no lympho-depleting chemotherapy is administered, and a total BCMA-CART cell dose of 1 to $5 \times 10^8$ is administered (e.g., by infusion) with 10% of the cell dose on day 1 of treatment, 30% on day 2 of treatment, and 60% on day 3 of treatment. In embodiments, a lympho-depleting chemotherapy (cytoxan at 1.5 g/m$^2$) is administered three days before BCMA-CART cell administration, and then a total BCMA-CART cell dose of 1 to $5 \times 10^7$ is administered (e.g., by infusion) with 10% of the cell dose on day 1 of treatment, 30% on day 2 of treatment, and 60% on day 3 of treatment. In embodiments, a lympho-depleting chemotherapy (cytoxan at 1.5 g/m$^2$) is administered three days before BCMA-CART cell administration, and then a total BCMA-CART cell dose of 1 to $5 \times 10^8$ is administered (e.g., by infusion) with 10% of the cell dose on day 1 of treatment, 30% on day 2 of treatment, and 60% on day 3 of treatment.

In another aspect, the invention pertains to a method of conditioning a subject prior to cell transplantation comprising administering to the subject an effective amount of the cell of comprising a CAR molecule described herein. In one embodiment, the cell transplantation is a stem cell transplantation. The stem cell transplantation is a hematopoietic stem cell stransplantation or a bone marrow transplantation. In one embodiment, the cell transplantation is allogeneic or autologous.

In one embodiment, the conditioning a subject prior to cell transplantation comprises reducing the number of BCMA-expressing cells in a subject. The BCMA-expressing cells in the subject are BCMA-expressing normal cells or BCMA-expressing cancer cells, and in some cases, the condition in the subject will reduce both BCMA-expressing normal and cancer cells prior to a cell transplantation.

In another aspect, the invention pertains to the isolated nucleic acid molecule encoding a CAR of the invention, the isolated polypeptide molecule of a CAR of the invention, the vector comprising a CAR of the invention, and the cell comprising a CAR of the invention for use as a medicament, e.g., as described herein.

In another aspect, the invention pertains to a the isolated nucleic acid molecule encoding a CAR of the invention, the isolated polypeptide molecule of a CAR of the invention, the vector comprising a CAR of the invention, and the cell comprising a CAR of the invention for use in the treatment of a disease expressing BCMA, e.g., a disease expressing BCMA as described herein.

Additional features and embodiments of the aforesaid compositions and methods include one or more of the following:

In certain embodiments, the BCMA CAR molecule (e.g., a BCMA CAR nucleic acid or a BCMA CAR polypeptide as described herein), or the BCMA binding domain as described herein, includes one, two or three CDRs from the heavy chain variable region (e.g., HC CDR1, HC CDR2 and/or HC CDR3), provided in Table 1; and/or one, two or three CDRs from the light chain variable region (e.g., LC CDR1, LC CDR2 and/or LC CDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, C13F12.1, provided in Table 2; or a sequence substantially identical (e.g., 95-99% identical, or up to 5, 4, 3, 2, or 1 amino acid changes, e.g., substitutions (e.g., conservative substitutions)) to any of the aforesaid sequences.

In certain embodiments, the BCMA CAR molecule (e.g., a BCMA CAR nucleic acid or a BCMA CAR polypeptide as described herein), or the anti-BCMA antigen binding domain as described herein, includes one, two or three CDRs from the heavy chain variable region (e.g., HC CDR1, HC CDR2 and/or HC CDR3), provided in Table 3; and/or one, two or three CDRs from the light chain variable region (e.g., LC CDR1, LC CDR2 and/or LC CDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, C13F12.1, provided in Table 4; or a sequence substantially identical (e.g., 95-99% identical, or up to 5, 4, 3, 2, or 1 amino acid changes, e.g., substitutions (e.g., conservative substitutions)) to any of the aforesaid sequences. In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 5; and/or one, two or three CDRs from the light chain variable region (e.g., LC CDR1, LC CDR2 and/or LC CDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, C13F12.1, provided in Table 6; or a sequence substantially identical (e.g., 95-99% identical, or up to 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes
(i) a LC CDR1, LC CDR2 and LC CDR3 of any BCMA light chain binding domain amino acid sequences listed in Tables 8 or 10, in SEQ ID NO: 271 or 273, or in the LC CDRs in Tables 2, 3 or 6; and/or.
(ii) a HC CDR1, HC CDR2 and HC CDR3 of any BCMA heavy chain binding domain amino acid sequences listed in Tables 8 or 10, in SEQ ID NO: 271 or 273, or in the HC CDRs in Tables 1, 3 or 5.

In certain embodiments, the BCMA molecule (e.g., a BCMA CAR nucleic acid or a BCMA CAR polypeptide as described herein), or the anti-BCMA antigen binding domain as described herein, includes:
(1) three light chain (LC) CDRs chosen from one of the following:
(i) a LC CDR1 of SEQ ID NO: 504, LC CDR2 of SEQ ID NO: 544 and LC CDR3 of SEQ ID NO: 584 of BCMA-4 CAR (139103);
(ii) a LC CDR1 of SEQ ID NO: 514, LC CDR2 of SEQ ID NO: 554 and LC CDR3 of SEQ ID NO: 594 of BCMA-10 CAR (139109);
(iii) a LC CDR1 of SEQ ID NO: 516, LC CDR2 of SEQ ID NO: 556 and LC CDR3 of SEQ ID NO: 596 of BCMA-13 CAR (139112); or
(iv) a LC CDR1 of SEQ ID NO: 518, LC CDR2 of SEQ ID NO: 558 and LC CDR3 of SEQ ID NO: 598 of BCMA-15 CAR (139114); and/or
(2) three heavy chain (HC) CDRs chosen from one of the following:
(i) a HC CDR1 of SEQ ID NO: 384, HC CDR2 of SEQ ID NO: 424 and HC CDR3 of SEQ ID NO: 464 of BCMA-4 CAR (139103);
(ii) a HC CDR1 of SEQ ID NO: 394, HC CDR2 of SEQ ID NO: 434 and HC CDR3 of SEQ ID NO: 474 of BCMA-10 CAR (139109);
(iii) a HC CDR1 of SEQ ID NO: 396, HC CDR2 of SEQ ID NO: 436 and HC CDR3 of SEQ ID NO: 476 of BCMA-13 CAR (139112); or
(iv) a HC CDR1 of SEQ ID NO: 398, HC CDR2 of SEQ ID NO: 438 and HC CDR3 of SEQ ID NO: 478 of BCMA-15 (139114).

In certain embodiments, the BCMA CAR molecule (e.g., a BCMA CAR nucleic acid or a BCMA CAR polypeptide as described herein), or the anti-BCMA antigen binding domain as described herein, includes:
(1) three light chain (LC) CDRs chosen from one of the following:
(i) a LC CDR1 of SEQ ID NO: 744, LC CDR2 of SEQ ID NO: 784 and LC CDR3 of SEQ ID NO: 824 of BCMA-4 CAR (139103);
(ii) a LC CDR1 of SEQ ID NO: 754, LC CDR2 of SEQ ID NO: 794 and LC CDR3 of SEQ ID NO: 834 of BCMA-10 CAR (139109);
(iii) a LC CDR1 of SEQ ID NO: 756, LC CDR2 of SEQ ID NO: 796 and LC CDR3 of SEQ ID NO: 836 of BCMA-13 CAR (139112); or
(iv) a LC CDR1 of SEQ ID NO: 758, LC CDR2 of SEQ ID NO: 798 and LC CDR3 of SEQ ID NO: 838 of BCMA-15 CAR (139114); and/or
(2) three heavy chain (HC) CDRs chosen from one of the following:
(i) a HC CDR1 of SEQ ID NO: 624, HC CDR2 of SEQ ID NO: 664 and HC CDR3 of SEQ ID NO: 704 of BCMA-4 CAR (139103);
(ii) a HC CDR1 of SEQ ID NO: 634, HC CDR2 of SEQ ID NO: 674 and HC CDR3 of SEQ ID NO: 714 of BCMA-10 CAR (139109);
(iii) a HC CDR1 of SEQ ID NO: 636, HC CDR2 of SEQ ID NO: 676 and HC CDR3 of SEQ ID NO: 716 of BCMA-13 CAR (139112); or
(iv) a HC CDR1 of SEQ ID NO: 638, HC CDR2 of SEQ ID NO: 678 and HC CDR3 of SEQ ID NO: 718 of BCMA-15 CAR (139114).

In certain embodiments, the BCMA CAR molecule (e.g., a BCMA CAR nucleic acid or a BCMA CAR polypeptide as described herein), or the anti-BCMA antigen binding domain as described herein, includes:
(1) three light chain (LC) CDRs chosen from one of the following:
(i) a LC CDR1 of SEQ ID NO: 984 LC CDR2 of SEQ ID NO: 1024 and LC CDR3 of SEQ ID NO: 1064 of BCMA-4 CAR (139103);
(ii) a LC CDR1 of SEQ ID NO: 994, LC CDR2 of SEQ ID NO: 1034 and LC CDR3 of SEQ ID NO: 1074 of BCMA-10 CAR (139109);
(iii) a LC CDR1 of SEQ ID NO: 996, LC CDR2 of SEQ ID NO: 1036 and LC CDR3 of SEQ ID NO: 1076 of BCMA-13 CAR (139112); or
(iv) a LC CDR1 of SEQ ID NO: 998, LC CDR2 of SEQ ID NO: 1038 and LC CDR3 of SEQ ID NO: 1078 of BCMA-15 CAR (139114); and/or
(2) three heavy chain (HC) CDRs chosen from one of the following:
(i) a HC CDR1 of SEQ ID NO: 864, HC CDR2 of SEQ ID NO: 904 and HC CDR3 of SEQ ID NO: 944 of BCMA-4 CAR (139103);
(ii) a HC CDR1 of SEQ ID NO: 874, HC CDR2 of SEQ ID NO: 914 and HC CDR3 of SEQ ID NO: 954 of BCMA-10 CAR (139109);
(iii) a HC CDR1 of SEQ ID NO: 876, HC CDR2 of SEQ ID NO: 916 and HC CDR3 of SEQ ID NO: 956 of BCMA-13 CAR (139112);
(iv) a HC CDR1 of SEQ ID NO: 878, HC CDR2 of SEQ ID NO: 918 and HC CDR3 of SEQ ID NO: 958 of BCMA-15 CAR (139114).

In certain embodiments, the BCMA CAR molecule (e.g., a BCMA CAR nucleic acid or a BCMA CAR polypeptide as described herein), or the anti-BCMA antigen binding domain as described herein, includes the humanized scFv amino acid sequence of SEQ ID NO: 271 or 273 or a nucleotide sequence encoding scFv (SEQ ID NO: 272 or 274), or an antigen binding domain thereof (e.g., a VH, VL or one or more CDRs thereof).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting. Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another. Other features, objects, and advantages of the invention will be apparent from the description and drawings, and from the claims.

BRIEF DESCRIPTION OF THE DRAWINGS

FIG. 5 is a schematic representation of the four CAR constructs containing humanized murine anti-BCMA scFvs, designated pBCMA1, pBCMA2, pBCMA3, and pBCMA4.

FIG. 9A shows the quantification of mean bioluminescence representing disease burden in the whole animal (represented by photons/second). FIG. 9B shows pictures of the bioluminescence detected in the treated mice at 5, 15, and 20 days after treatment.

FIGS. 23A, 23B, 23C, and 23D are a series of graphs showing BCMA CART killing in response to BCMA-expressing KMS11-luciferase target cells, by luciferase assay. Killing capacity (percent of target cells killed) of each BCMA CAR construct is compared to BCMA-3NP and BCMA-4NP in each graph in FIG. 23A. In FIG. 23B, select BCMA CAR constructs were compared to each other. In FIG. 23C, the effector:target ratio was normalized to the CAR-expressing cells. X-axis represents the percent of target cells killed; Y-axis represents effector:target (E:T) ratio.

In FIG. 25B, BCMA-4NP* denotes the BCMA-4NP results from the first experiment (results shown in FIG. 25A).

FIG. 35A is a graph showing the concentration of interleukin-2 (IL-2) and interferon-gamma (IFNγ) secreted by BCMA-10 CARTs. FIG. 35B is a graph showing the concentration of tumor necrosis factor-alpha (TNF-α) secreted by BCMA-10 CARTs.

FIG. 36A is a graph showing the number of T cell transduced with huBCMA-BBz vector on several days after expansion. FIG. 36B is a panel of flow cytometry plots showing the expression on day 6 of ex vivo expansion of BCMA on CART-BCMA cells (T cells transduced with huBCMA-BBz vector) compared to non-transduced NTD cells.

FIG. 38A shows the concentration of IL-2 produced, and FIG. 38B shows the concentration of IFN-γ produced. Values represent cytokine concentration in pg/mL.

FIG. 39A shows the antigen-specific killing of K562-BCMA cells, FIG. 39B shows the antigen specific killing of RPMI 8226 cells, and FIG. 39C shows the antigen specific killing of MM1S cells.

FIG. 40A is a graph showing total radiance in non-transduced mice, and FIG. 40B is a graph showing total radiance in CART-BCMA mice. FIG. 40C is a graph showing percent survival of NTD or CART-BCMA mice after T cell injection. Dorsal photon emission from RPMI 8226 CBG+ tumors are shown with individual animals depicted in grey and median total radiance shown in red. n=10 for each group. Time is shown in weeks following T cell injection.

FIG. 45A shows day 0 PK following the first dose of RAD001. FIG. 45B shows Day 14 PK following the final RAD001 dose. Diamonds denote the 10 mg/kg dose of RAD001; squares denote the 1 mg/kg dose of RAD001; triangles denote the 3 mg/kg dose of RAD001; and x's denote the 10 mg/kg dose of RAD001.

FIG. 46A shows CD4+ CAR T cells; FIG. 46B shows CD8+ CAR T cells. Circles denote PBS; squares denote huCTL019; triangles denote huCTL019 with 3 mg/kg RAD001; inverted triangles denote huCTL019 with 0.3 mg/kg RAD001; diamonds denote huCTL019 with 0.03 mg/kg RAD001; and circles denote huCTL019 with 0.003 mg/kg RAD001.

DETAILED DESCRIPTION

Definitions

Figure 1A:
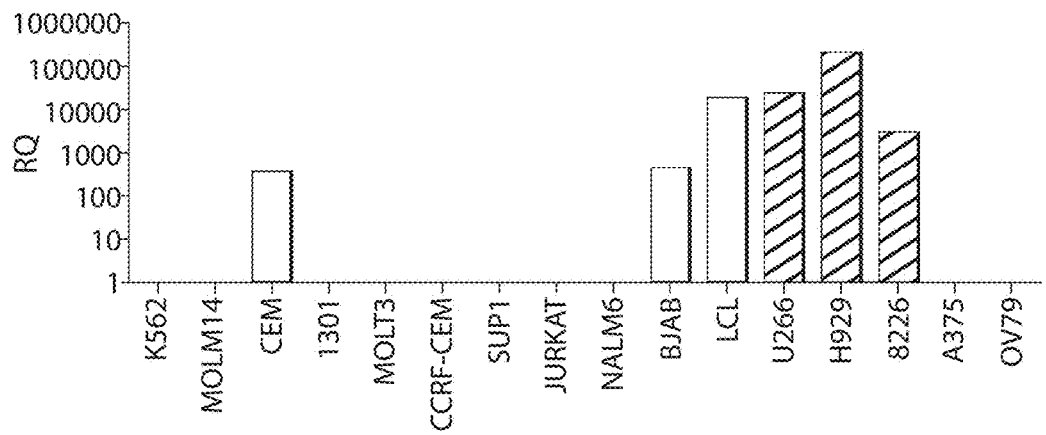
FIGS. 1A and 1B are two graphical representations of BCMA expression in myeloma samples as determined by quantitative PCR. BCMA expression was determined in different myeloma cell lines (FIG. 1A). BCMA expression was compared between normal plasma cells and myeloma patient samples (FIG. 1B)

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "Chimeric Antigen Receptor" or alternatively a "CAR" refers to a recombinant polypeptide construct comprising at least an extracellular antigen binding domain, a transmembrane domain and a cytoplasmic signaling domain (also referred to herein as "an intracellular signaling domain") comprising a functional signaling domain derived from a stimulatory molecule as defined below. In some embodiments, the domains in the CAR polypeptide construct are in the same polypeptide chain, e.g., comprise a chimeric fusion protein. In some embodiments, the domains in the CAR polypeptide construct are not contiguous with each other, e.g., are in different polypeptide chains, e.g., as provided in an RCAR as described herein.

In one aspect, the stimulatory molecule of the CAR is the zeta chain associated with the T cell receptor complex. In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule is chosen from 4-1BB (i.e., CD137), CD27, ICOS, and/or CD28. In one aspect, the CAR comprises a chimeric fusion protein comprising an extracellular antigen recognition domain, a transmembrane domain and an intracellular signaling domain comprising a functional signaling domain derived from a stimulatory molecule. In one aspect, the CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In one aspect, the CAR comprises a chimeric fusion protein comprising an extracellular antigen recognition domain, a transmembrane domain and an intracellular signaling domain comprising two functional signaling domains derived from one or more co-stimulatory molecule(s) and a functional signaling domain derived from a stimulatory molecule. In one aspect, the CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen recognition domain, wherein the leader sequence is optionally cleaved from the antigen recognition domain (e.g., aa scFv) during cellular processing and localization of the CAR to the cellular membrane.

A CAR that comprises an antigen binding domain (e.g., a scFv, a single domain antibody, or TCR (e.g., a TCR alpha binding domain or TCR beta binding domain)) that targets a specific tumor marker X, wherein X can be a tumor marker as described herein, is also referred to as XCAR. For example, a CAR that comprises an antigen binding domain that targets BCMA is referred to as BCMACAR. The CAR can be expressed in any cell, e.g., an immune effector cell as described herein (e.g., a T cell or an NK cell).

The term "signaling domain" refers to the functional portion of a protein which acts by transmitting information within the cell to regulate cellular activity via defined signaling pathways by generating second messengers or functioning as effectors by responding to such messengers.

As used herein, the term "BCMA" refers to B-cell maturation antigen. BCMA (also known as TNFRSF17, BCM or CD269) is a member of the tumor necrosis receptor (TNFR) family and is predominantly expressed on terminally differentiated B cells, e.g., memory B cells, and plasma cells. Its ligand is called B-cell activator of the TNF family (BAFF) and a proliferation inducing ligand (APRIL). BCMA is involved in mediating the survival of plasma cells for mataining long-term humoral immunity. The gene for BCMA is encoded on chromosome 16 producing a primary mRNA transcript of 994 nucleotides in length (NCBI accession NM_001192.2) that encodes a protein of 184 amino acids (NP_001183.2). A second antisense transcript derived from the BCMA locus has been described, which may play a role in regulating BCMA expression. (Laabi Y. et al., Nucleic Acids Res., 1994, 22:1147-1154). Additional transcript variants have been described with unknown significance (Smirnova A S et al. Mol Immunol., 2008, 45(4): 1179-1183. A second isoform, also known as TV4, has been identified (Uniprot identifier Q02223-2). As used herein, "BCMA" includes proteins comprising mutations, e.g., point mutations, fragments, insertions, deletions and splice variants of full length wild-type BCMA.

The term "antibody," as used herein, refers to a protein, or polypeptide sequence derived from an immunoglobulin molecule, which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an intact antibody, or recombinant variants thereof, and refers to the antigen binding domain, e.g., an antigenic determining variable region of an intact antibody, that is sufficient to confer recognition and specific binding of the antibody fragment to a target, such as an antigen. Examples of antibody fragments include, but are not limited to, Fab, Fab', F(ab')$_2$, and Fv fragments, scFv antibody fragments, linear antibodies, single domain antibodies such as sdAb (either VL or VH), camelid VHH domains, and multi-specific molecules formed from antibody fragments such as a bivalent fragment comprising two or more, e.g., two, Fab fragments linked by a disulfide brudge at the hinge region, or two or more, e.g., two isolated CDR or other epitope binding fragments of an antibody linked. An antibody fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antibody fragments can also be grafted into scaffolds based on polypeptides such as a fibronectin type III (Fn3)(see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The terms "complementarity determining region" or "CDR," as used herein, refer to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273, 927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

The portion of the CAR composition of the invention comprising an antibody or antibody fragment thereof may exist in a variety of forms, for example, where the antigen binding domain is expressed as part of a polypeptide chain including, for example, a single domain antibody fragment (sdAb), a single chain antibody (scFv), or e.g., a humanized antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

As used herein, the term "binding domain" or "antibody molecule" (also referred to herein as "anti-target (e.g., BCMA) binding domain") refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "anti-tumor effect" refers to a biological effect which can be manifested by various means, including but not limited to, e.g., a decrease in tumor volume, a decrease in the number of tumor cells, a decrease in the number of metastases, an increase in life expectancy, decrease in tumor cell proliferation, decrease in tumor cell survival, or amelioration of various physiological symptoms associated with the cancerous condition. An "anti-tumor effect" can also be manifested by the ability of the peptides, polynucleotides, cells and antibodies of the invention in prevention of the occurrence of tumor in the first place.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival. The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to a graft derived from an animal of a different species.

The term "apheresis" as used herein refers to the art-recognized extracorporeal process by which the blood of a donor or patient is removed from the donor or patient and passed through apparatus that separates out selected particular constituent(s) and returns the remainder to the circulation of the donor or patient, e.g., by retransfusion. Thus, in the context of "an apheresis sample" refers to a sample obtained using apheresis.

The term "combination" refers to either a fixed combination in one dosage unit form, or a combined administration where a compound of the present invention and a combination partner (e.g. another drug as explained below, also referred to as "therapeutic agent" or "co-agent") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time. The term "pharmaceutical combination" as used herein means a product that results from the mixing or combining of more than one active ingredient and includes both fixed and non-fixed combinations of the active ingredients. The term "fixed combination" means that the active ingredients, e.g. a compound of the present invention and a combination partner, are both administered to a patient simultaneously in the form of a single entity or dosage. The term "non-fixed combination" means that the active ingredients, e.g. a compound of the present invention and a combination partner, are both administered to a patient as separate entities either simultaneously, concurrently or sequentially with no specific time limits, wherein such administration provides therapeutically effective levels of the two compounds in the body of the patient. The latter also applies to cocktail therapy, e.g. the administration of three or more active ingredients.

The term "cancer" refers to a disease characterized by the rapid and uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. Preferred cancers treated by the methods described herein include multiple myeloma, Hodgkin's lymphoma or non-Hodgkin's lymphoma.

The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of BCMA" includes, but is not limited to, a disease associated with a cell which expresses BCMA (e.g., wild-type or mutant BCMA) or condition associated with a cell which expresses BCMA (e.g., wild-type or mutant BCMA) including, e.g., proliferative diseases such as a cancer or malignancy or a precancerous condition such as a myelodysplasia, a myelodysplastic syndrome or a preleukemia; or a noncancer related indication associated with a cell which expresses BCMA (e.g., wild-type or mutant BCMA). For the avoidance of doubt, a disease associated with expression of BCMA may include a condition associated with a cell which does not presently express BCMA, e.g., because BCMA expression has been downregulated, e.g., due to treatment with a molecule targeting BCMA, e.g., a BCMA inhibitor described herein, but which at one time expressed BCMA. In one aspect, a cancer associated with expression of BCMA (e.g., wild-type or mutant BCMA) is a hematological cancer. In one aspect, the hematogical cancer is a leukemia or a lymphoma. In one aspect, a cancer associated with expression of BCMA (e.g., wild-type or mutant BCMA) is a malignancy of differentiated plasma B cells. In one aspect, a cancer associated with expression of BCMA (e.g., wild-type or mutant BCMA) includes cancers and malignancies including, but not limited to, e.g., one or more acute leukemias including but not limited to, e.g., B-cell acute Lymphoid Leukemia ("BALL"), T-cell acute Lymphoid Leukemia ("TALL"), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of BMCA (e.g., wild-type or mutant BCMA) comprise, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. In some embodiments, the cancer is multiple myeloma, Hodgkin's lymphoma, non-Hodgkin's lymphoma, or glioblastoma. In embodiments, a disease associated with expression of BCMA includes a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome). Further diseases associated with expression of BCMA (e.g., wild-type or mutant BCMA) expression include, but not limited to, e.g., atypical and/or non-classical cancers, malignancies, precancerous conditions or proliferative diseases associated with expression of BCMA (e.g., wild-type or mutant BCMA), e.g., a cancer described herein, e.g., a prostate cancer (e.g., castrate-resistant or therapy-resistant prostate cancer, or metastatic prostate cancer), pancreatic cancer, or lung cancer.

Non-cancer related conditions that are associated with BCMA (e.g., wild-type or mutant BCMA) include viral infections; e.g., HIV, fungal invections, e.g., *C. neoformans*; autoimmune disease; e.g. rheumatoid arthritis, system lupus erythematosus (SLE or lupus), pemphigus vulgaris, and Sjogren's syndrome; inflammatory bowel disease, ulcerative colitis; transplant-related allospecific immunity disorders related to mucosal immunity; and unwanted immune responses towards biologics (e.g., Factor VIII) where humoral immunity is important. In embodiments, a non-cancer related indication associated with expression of BCMA includes but is not limited to, e.g., autoimmune disease, (e.g., lupus), inflammatory disorders (allergy and asthma) and transplantation. In some embodiments, the tumor antigen-expressing cell expresses, or at any time expressed, mRNA encoding the tumor antigen. In an embodiment, the tumor antigen-expressing cell produces the tumor antigen protein (e.g., wild-type or mutant), and the tumor antigen protein may be present at normal levels or reduced levels. In an embodiment, the tumor antigen-expressing cell produced detectable levels of a tumor antigen protein at one point, and subsequently produced substantially no detectable tumor antigen protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, such as downregulation of TGF-β, and/or reorganization of cytoskeletal structures, and the like.

The term "stimulatory molecule," refers to a molecule expressed by a T cell that provides the primary cytoplasmic signaling sequence(s) that regulate primary activation of the TCR complex in a stimulatory way for at least some aspect of the T cell signaling pathway. In some embodiments, the ITAM-containing domain within the CAR recapitulates the signaling of the primary TCR independently of endogenous TCR complexes. In one aspect, the primary signal is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing primary cytoplasmic signaling sequence that is of particular use in the invention includes, but is not limited to, those derived from TCR zeta, FcR gamma, FcR beta, CD3 gamma, CD3 delta, CD3 epsilon, CD5, CD22, CD79a, CD79b, CD278 (also known as "ICOS"), FcεRI and CD66d, DAP10 and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:9, or the equivalent residues from a non-human species, e.g., mouse, rodent, monkey, ape and the like. In a specific CAR of the invention, the primary signaling sequence of CD3-zeta is the sequence as provided in SEQ ID NO:10, or the equivalent residues from a non-human species, e.g., mouse, rodent, monkey, ape and the like. The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. In embodiments, the intracellular signal domain transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, CD278 (also known as "ICOS"), FcεRI, CD66d, DAP10 and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:9. In one aspect, the "zeta stimulatory domain" or a "CD3-zeta stimulatory domain" is the sequence provided as SEQ ID NO:10.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to an MHC class I molecule, TNF receptor proteins, Immunoglobulin-like proteins, cytokine receptors, integrins, signaling lymphocytic activation molecules (SLAM proteins), activating NK cell receptors, BTLA, Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain refers to the intracellular portion of a costimulatory molecule.

The intracellular signaling domain can comprise the entire intracellular portion, or the entire native intracellular signaling domain, of the molecule from which it is derived, or a functional fragment thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:7 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "effector function" refers to a specialized function of a cell. Effector function of a T cell, for example, may be cytolytic activity or helper activity including the secretion of cytokines.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions, e.g., conservative substitutions), alleles, orthologs, SNPs, and complementary sequences as well as the sequence explicitly indicated. Specifically, degenerate codon substitutions, e.g., conservative substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically a protein, carbohydrate or lipid) that is expressed on the surface of a cancer cell, either entirely or as a fragment (e.g., MHC/peptide), and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some enbodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "tumor-supporting antigen" or "cancer-supporting antigen" interchangeably refer to a molecule (typically a protein, carbohydrate or lipid) that is expressed on the surface of a cell that is, itself, not cancerous, but supports the cancer cells, e.g., by promoting their growth or survival e.g., resistance to immune cells. Exemplary cells of this type include stromal cells and myeloid-derived suppressor cells (MDSCs). The tumor-supporting antigen itself need not play a role in supporting the tumor cells so long as the antigen is present on a cell that supports cancer cells.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)$_n$ (SEQ ID NO: 38)., where n is a positive integer equal to or greater than 1. For example, n=1, n=2, n=3. n=4, n=5 and n=6, n=7, n=8, n=9 and n=10 In one embodiment, the flexible polypeptide linkers include, but are not limited to, (Gly$_4$ Ser)$_4$ (SEQ ID NO:27) or (Gly$_4$ Ser)$_3$ (SEQ ID NO:28). In another embodiment, the linkers include multiple repeats of (Gly2Ser), (GlySer) or (Gly3Ser) (SEQ ID NO:29). Also included within the scope of the invention are linkers described in WO2012/138475, incorporated herein by reference).

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 30), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer (e.g., castrate-resistant or therapy-resistant prostate cancer, or metastatic prostate cancer), ovarian cancer, pancreatic cancer, and the like, or a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a cognate binding partner (e.g., a stimulatory and/or costimulatory molecule present on a T cell) protein present in a sample, but which antibody or ligand does not substantially recognize or bind other molecules in the sample.

"Regulatable chimeric antigen receptor (RCAR)," as used herein, refers to a set of polypeptides, typically two in the simplest embodiments, which when in an immune effector cell, provides the cell with specificity for a target cell, typically a cancer cell, and with intracellular signal generation. In some embodiments, an RCAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined herein in the context of a CAR molecule. In some embodiments, the set of polypeptides in the RCAR are not contiguous with each other, e.g., are in different polypeptide chains. In some embodiments, the RCAR includes a dimerization switch that, upon the presence of a dimerization molecule, can couple the polypeptides to one another, e.g., can couple an antigen binding domain to an intracellular signaling domain. In some embodiments, the RCAR is expressed in a cell (e.g., an immune effector cell) as described herein, e.g., an RCAR-expressing cell (also referred to herein as "RCARX cell"). In an embodiment the RCARX cell is a T cell, and is referred to as a RCART cell. In an embodiment the RCARX cell is an NK cell, and is referred to as a RCARN cell. The RCAR can provide the RCAR-expressing cell with specificity for a target cell, typically a cancer cell, and with regulatable intracellular signal generation or proliferation, which can optimize an immune effector property of the RCAR-expressing cell. In embodiments, an RCAR cell relies at least in part, on an antigen binding domain to provide specificity to a target cell that comprises the antigen bound by the antigen binding domain.

"Membrane anchor" or "membrane tethering domain", as that term is used herein, refers to a polypeptide or moiety, e.g., a myristoyl group, sufficient to anchor an extracellular or intracellular domain to the plasma membrane.

"Switch domain," as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g, RAD001.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "low, immune enhancing, dose" when used in conjuction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive immune effector cells, e.g., T cells or NK cells, and/or an increase in the number of PD-1 negative immune effector cells, e.g., T cells or NK cells, or an increase in the ratio of PD-1 negative immune effector cells (e.g., T cells or NK cells)/PD-1 positive immune effector cells (e.g., T cells or NK cells).

In an embodiment, the low, immune enhancing, dose of mTOR inhibitor results in an increase in the number of naive T cells. In an embodiment, the low, immune enhancing, dose of mTOR inhibitor results in one or more of the following:
an increase in the expression of one or more of the following markers: $CD62L^{high}$, $CD127^{high}$, $CD27^+$, and BCL2, e.g., on memory T cells, e.g., memory T cell precursors;
a decrease in the expression of KLRG1, e.g., on memory T cells, e.g., memory T cell precursors; and
an increase in the number of memory T cell precursors, e.g., cells with any one or combination of the following characteristics: increased $CD62L^{high}$, increased $CD127^{high}$, increased $CD27^+$, decreased KLRG1, and increased BCL2;
wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" or a "relapse" as used herein refers to the reappearance of a disease (e.g., cancer) or the signs and symptoms of a disease such as cancer after a period of improvement or responsiveness, e.g., after prior treatment of a therapy, e.g., cancer therapy. For example, the period of responsiveness may involve the level of cancer cells falling below a certain threshold, e.g., below 20%, 1%, 10%, 5%, 4%, 3%, 2%, or 1%. The reappearance may involve the level of cancer cells rising above a certain threshold, e.g., above 20%, 1%, 10%, 5%, 4%, 3%, 2%, or 1%.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Description

Provided herein are compositions of matter and methods of use for the treatment of a disease such as cancer using cells expressing BCMA chimeric antigen receptors (CAR), e.g., CART-BCMA.

In one aspect, the invention provides a number of chimeric antigen receptors (CAR) comprising an antibody or antibody fragment engineered for enhanced binding to a BCMA protein. In one aspect, the invention provides a cell (e.g., an immune effector cell, e.g., T cell or NK cell) engineered to express a CAR, wherein the CAR T cell ("CART") or CAR NK cell exhibits an antitumor property. In one aspect a cell is transformed with the CAR and the CAR is expressed on the cell surface. In some embodiments, the cell (e.g., an immune effector cell, e.g., T cell or NK cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., an immune effector cell, e.g., T cell or NK cell) is transfected with a nucleic acid, e.g., mRNA, cDNA, DNA, encoding a CAR. In some such embodiments, the cell may transiently express the CAR.

In one aspect, the anti-BCMA antigen binding portion of the CAR is a scFv antibody fragment. In one aspect such antibody fragments are functional in that they retain the equivalent binding affinity, e.g., they bind the same antigen with comparable efficacy, as the IgG antibody from which it is derived. In other embodiments, the antibody fragment has a lower binding affinity, e.g., it binds the same antigen with a lower binding affinity than the antibody from which it is derived, but is functional in that it provides a biological response described herein. In one embodiment, the CAR molecule comprises an antibody fragment that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the antibody fragment has a binding affinity that is at least five-fold, 10-fold, 20-fold, 30-fold, 50-fold, 100-fold or 1,000-fold less than a reference antibody, e.g., an antibody described herein.

In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan. In one aspect, the anti-BCMA antigen binding domain of the CAR is a scFv antibody fragment that is humanized compared to the murine sequence of the scFv from which it is derived. In one embodiment, the anti-BCMA antigen binding domain is a human anti-BCMA antigen binding domain. In one embodiment, the anti-BCMA antigen binding domain is a humanized anti-BCMA antigen binding domain.

In some aspects, the antibodies of the invention are incorporated into a chimeric antigen receptor (CAR). In one aspect, the CAR comprises a BCMA binding domain comprising a sequence of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO:129, SEQ ID NO:130, SEQ ID NO:131, SEQ ID NO:132, SEQ ID NO:133, SEQ ID NO:134, SEQ ID NO: 135, SEQ ID NO:136, SEQ ID NO: 137, SEQ ID NO:138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, or SEQ ID NO: 266. In one aspect, the scFv domains are human. In another aspect, the scFv domains are humanized variants of the scFv domain of the antibodies or antibody fragments described in PCT Publication No. WO 2012/163805, U.S. Pat. No. 7,083,785, EP Patent No. 1975231B1, or PCT Publication No. WO 13/154760 (the contents of each are hereby incorporated by reference in their entireties), which disclose antibodies or scFv fragments of murine origin that specifically binds to human BCMA. Humanization of these mouse antibodies and/or scFvs may be desired for the clinical setting, where the mouse-specific residues may induce a human-anti-mouse antigen (HAMA) response in patients who receive CART-BCMA treatment, e.g., treatment with immune effector cells, e.g., T cells or NK cells, transduced with the anti-BCMA CAR construct.

In one aspect, the anti-BCMA binding domain, e.g., human or humanized scFv, portion of a CAR of the invention is encoded by a transgene whose sequence has been codon optimized for expression in a mammalian cell. In one aspect, entire CAR construct of the invention is encoded by a transgene whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

In one aspect, the human anti-BCMA binding domain comprises the scFv portion provided in SEQ ID NO: 39. In one aspect, the human anti-BCMA CAR comprises the scFv portion provided in SEQ ID NO: 40. In one aspect, the human anti-BCMA binding domain comprises the scFv portion provided in SEQ ID NO: 41. In one aspect, the human anti-BCMA binding domain comprises the scFv portion provided in SEQ ID NO: 42. In one aspect, the human anti-BCMA binding domain comprises the scFv portion provided in SEQ ID NO: 43. In one aspect, the human anti-BCMA binding domain comprises the scFv portion provided in SEQ ID NO: 44. In one aspect, the human anti-BCMA binding domain comprises the scFv portion provided in SEQ ID NO: 45. In one aspect, the human anti-BCMA binding domain comprises the scFv portion provided in SEQ ID NO: 46. In one aspect, the human anti-BCMA binding domain comprises the scFv portion provided in SEQ ID NO: 47. In one aspect, the human anti-BCMA binding domain comprises the scFv portion provided in SEQ ID NO: 48. In one aspect, the human anti-BCMA binding domain comprises the scFv portion provided in SEQ ID NO: 49. In one aspect, the human anti-BCMA binding domain comprises the scFv portion provided in SEQ ID NO: 50. In one aspect, the human anti-BCMA binding domain comprises the scFv portion provided in SEQ ID NO: 51. In one aspect, the human anti-BCMA binding domain comprises the scFv portion provided in SEQ ID NO: 52. In one aspect, the human anti-BCMA binding domain comprises the scFv portion provided in SEQ ID NO: 53. In one aspect, the human anti-BCMA binding domain comprises the scFv portion provided in SEQ ID NO: 129. In one aspect, the human anti-BCMA binding domain comprises the scFv portion provided in SEQ ID NO: 130. In one aspect, the human anti-BCMA CAR comprises the scFv portion provided in SEQ ID NO: 131. In one aspect, the human anti-BCMA binding domain comprises the scFv portion provided in SEQ ID NO: 132. In one aspect, the human anti-BCMA binding domain comprises the scFv portion provided in SEQ ID NO: 133. In one aspect, the human anti-BCMA binding domain comprises the scFv portion provided in SEQ ID NO: 134. In one aspect, the human anti-BCMA binding domain comprises the scFv portion provided in SEQ ID NO: 135. In one aspect, the human anti-BCMA binding domain comprises the scFv portion provided in SEQ ID NO: 136. In one aspect, the human anti-BCMA binding domain comprises the scFv portion provided in SEQ ID NO: 137. In one aspect, the human anti-BCMA binding domain comprises the scFv portion provided in SEQ ID NO: 138. In one aspect, the human anti-BCMA binding domain comprises the scFv portion provided in SEQ ID NO: 139. In one aspect, the human anti-BCMA binding domain comprises the scFv portion provided in SEQ ID NO: 140. In one aspect, the human anti-BCMA binding domain comprises the scFv portion provided in SEQ ID NO: 141. In one aspect, the human anti-BCMA CAR comprises the scFv portion provided in SEQ ID NO: 142. In one aspect, the human anti-BCMA CAR comprises the scFv portion provided in SEQ ID NO: 143. In one aspect, the human anti-BCMA CAR comprises the scFv portion provided in SEQ ID NO: 144. In one aspect, the human anti-BCMA CAR comprises the scFv portion provided in SEQ ID NO: 145. In one aspect, the human anti-BCMA CAR comprises the scFv portion provided in SEQ ID NO: 146. In one aspect, the human anti-BCMA CAR comprises the scFv portion provided in SEQ ID NO: 147. In one aspect, the human anti-BCMA CAR comprises the scFv portion provided in SEQ ID NO: 148. In one aspect, the human anti-BCMA CAR comprises the scFv portion provided in SEQ ID NO: 149. In one aspect, the humanized anti-BCMA binding domain comprises the scFv portion provided in SEQ ID NO: 255. In one aspect, the humanized anti-BCMA CAR comprises the scFv portion provided in SEQ ID NO: 257.

In one aspect, the human anti-BCMA CAR comprises the scFv portion provided in SEQ ID NO: 263. In one aspect, the human anti-BCMA CAR comprises the scFv portion provided in SEQ ID NO: 264. In one aspect, the human anti-BCMA CAR comprises the scFv portion provided in SEQ ID NO: 265. In one aspect, the human anti-BCMA CAR comprises the scFv portion provided in SEQ ID NO: 266.

In one aspect, the CARs of the invention combine an antigen binding domain of a specific antibody with an intracellular signaling molecule. For example, in some aspects, the intracellular signaling molecule includes, but is not limited to, CD3-zeta chain, 4-1BB and CD28 signaling modules and combinations thereof. In one aspect, the antigen binding domain binds to BCMA. In one aspect, the BCMA CAR comprises a CAR selected from the sequence provided in one or more of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, and SEQ ID NO: 233. In one aspect, the BCMA CAR comprises the sequence provided in SEQ ID NO:99. In one aspect, the BCMA CAR comprises the sequence provided in SEQ ID NO:100. In one aspect, the BCMA CAR comprises the sequence provided in SEQ ID NO:101. In one aspect, the BCMA CAR comprises the sequence provided in SEQ ID NO:102. In one aspect, the BCMA CAR comprises the sequence provided in SEQ ID NO:103. In one aspect, the BCMA CAR comprises the sequence provided in SEQ ID NO:104. In one aspect, the BCMA CAR comprises the sequence provided in SEQ ID NO:105. In one aspect, the BCMA CAR comprises the sequence provided in SEQ ID NO:106. In one aspect, the BCMA CAR comprises the sequence provided in SEQ ID NO:107. In one aspect, the BCMA CAR comprises the sequence provided in SEQ ID NO:108. In one aspect, the BCMA CAR comprises the sequence provided in SEQ ID NO:109. In one aspect, the BCMA CAR comprises the sequence provided in SEQ ID NO:110. In one aspect, the BCMA CAR comprises the sequence provided in SEQ ID NO:111. In one aspect, the BCMA CAR comprises the sequence provided in SEQ ID NO:112. In one aspect, the BCMA CAR comprises the sequence provided in SEQ ID NO:213. In one aspect, the BCMA CAR comprises the sequence provided in SEQ ID NO:214. In one aspect, the BCMA CAR comprises the sequence provided in SEQ ID NO:215. In one aspect, the BCMA CAR comprises the sequence provided in SEQ ID NO:216. In one aspect, the BCMA CAR comprises the sequence provided in SEQ ID NO:217. In one aspect, the BCMA CAR comprises the sequence provided in SEQ ID NO:218. In one aspect, the BCMA CAR comprises the sequence provided in SEQ ID NO:219. In one aspect, the BCMA CAR comprises the sequence provided in SEQ ID NO:220. In one aspect, the BCMA CAR comprises the sequence provided in SEQ ID NO:221. In one aspect, the BCMA CAR comprises the sequence provided in SEQ ID NO:222. In one aspect, the BCMA CAR comprises the sequence provided in SEQ ID NO:223. In one aspect, the BCMA CAR comprises the sequence provided in SEQ ID NO:224. In one aspect, the BCMA CAR comprises the sequence provided in SEQ ID NO:225. In one aspect, the BCMA CAR comprises the sequence provided in SEQ ID NO:226. In one aspect, the BCMA CAR comprises the sequence provided in SEQ ID NO:227. In one aspect, the BCMA CAR comprises the sequence provided in SEQ ID NO:228. In one aspect, the BCMA CAR comprises the sequence provided in SEQ ID NO:229. In one aspect, the BCMA CAR comprises the sequence provided in SEQ ID NO:230. In one aspect, the BCMA CAR comprises the sequence provided in SEQ ID NO:231. In one aspect, the BCMA CAR comprises the sequence provided in SEQ ID NO:232. In one aspect, the BCMA CAR comprises the sequence provided in SEQ ID NO:233.

Furthermore, the present invention provides BCMA CAR compositions and their use in medicaments or methods for treating, among other diseases, cancer or any malignancy or autoimmune diseases involving cells or tissues which express BCMA In one aspect, the CAR of the invention can be used to eradicate BCMA-expressing normal cells, thereby applicable for use as a cellular conditioning therapy prior to cell transplantation. In one aspect, the BCMA-expressing normal cell is a BCMA-expressing normal stem cell and the cell transplantation is a stem cell transplantation.

In one aspect, the invention provides a cell (e.g., T cell or NK cell) engineered to express a chimeric antigen receptor (CAR), wherein the CAR T cell ("CART") or the CAR NK cell exhibits an antitumor property. A preferred antigen is BCMA. In one aspect, the antigen binding domain of the CAR comprises a human anti-BCMA antibody fragment or a partially humanized anti-BCMA antibody fragment. In one aspect, the antigen binding domain of the CAR comprises human anti-BCMA antibody fragment or a partially humanized anti-BCMA antibody fragment comprising an scFv. Accordingly, the invention provides a BCMA-CAR that comprises a humanized anti-BCMA binding domain and is engineered into a cell, e.g., a T cell or NK cell, and methods of their use for adoptive therapy.

In one aspect, the BCMA-CAR comprises at least one intracellular domain selected from the group of a CD137 (4-1BB) signaling domain, a CD28 signaling domain, a CD3zeta signal domain, and any combination thereof. In one aspect, the BCMA-CAR comprises at least one intracellular signaling domain is from one or more co-stimulatory molecule(s) other than a CD137 (4-1BB) or CD28.

Chimeric Antigen Receptor (CAR)

The present invention provides a CAR (e.g., a CAR polypeptide) that comprises an anti-BCMA binding domain (e.g., human or humanized BCMA binding domain as described herein), a transmembrane domain, and an intracellular signaling domain, and wherein said anti-BCMA binding domain comprises a heavy chain complementary determining region 1 (HC CDR1), a heavy chain complementary determining region 2 (HC CDR2), and a heavy chain complementary determining region 3 (HC CDR3) of any anti-BMCA heavy chain binding domain amino acid sequences listed in Tables 8 or 10. The anti-BCMA binding domain of the CAR can further comprise a light chain complementary determining region 1 (LC CDR1), a light chain complementary determining region 2 (LC CDR2), and a light chain complementary determining region 3 (LC CDR3) of any anti-BMCA heavy chain binding domain amino acid sequences listed in Tables 8 or 10.

The present invention also provides nucleic acid molecules encoding the CAR as described herein, e.g., encoding a CAR that comprises an anti-BCMA binding domain (e.g., human or humanized BCMA binding domain as described herein), a transmembrane domain, and an intracellular signaling domain, and wherein said anti-BCMA binding domain comprises a heavy chain complementary determining region 1 (HC CDR1), a heavy chain complementary determining region 2 (HC CDR2), and a heavy chain complementary determining region 3 (HC CDR3) of any anti-BMCA heavy chain binding domain amino acid sequences listed in Tables 8 or 10. In one embodiment, the encoded anti-BCMA binding domain of the CAR can further comprise a light chain complementary determining region 1 (LC CDR1), a light chain complementary determining region 2 (LC CDR2), and a light chain complementary determining region 3 (LC CDR3) of any anti-BMCA heavy chain binding domain amino acid sequences listed in Tables 8 or 10.

In specific aspects, a CAR construct of the invention comprises a scFv domain selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, and SEQ ID NO: 266, wherein the scFv may be preceded by an optional leader sequence such as provided in SEQ ID NO: 1, and followed by an optional hinge sequence such as provided in SEQ ID NO:2 or SEQ ID NO:3 or SEQ ID NO:4 or SEQ ID NO:5, a transmembrane region such as provided in SEQ ID NO:6, an intracellular signalling domain that includes SEQ ID NO:7 or SEQ ID NO:8 and a CD3 zeta sequence that includes SEQ ID NO:9 or SEQ ID NO:10, wherein the domains are contiguous with and in the same reading frame to form a single fusion protein. Also included in the invention is a nucleotide sequence that encodes the polypeptide of each of the scFv fragments selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, and SEQ ID NO: 266.

Also included in the invention is a nucleotide sequence that encodes the polypeptide of each of the scFv fragments selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 263, SEQ ID NO: 264, SEQ ID NO: 265, and SEQ ID NO: 266, and each of the domains of SEQ ID NOS: 1, 2, and 6-9, plus the encoded BCMA CAR fusion protein of the invention.

In one aspect, an exemplary BCMA CAR constructs comprise an optional leader sequence, an extracellular antigen binding domain, a hinge, a transmembrane domain, and an intracellular stimulatory domain. In one aspect an exemplary BCMA CAR construct comprises an optional leader sequence, an extracellular antigen binding domain, a hinge, a transmembrane domain, an intracellular costimulatory domain and an intracellular stimulatory domain. Specific BCMA CAR constructs containing human scFv domains of the invention are provided as SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, and SEQ ID NO: 149. Full-length CAR sequences are also provided herein as SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, and SEQ ID NO: 149 as shown in Table 8.

An exemplary leader sequence is provided as SEQ ID NO: 1. An exemplary hinge/spacer sequence is provided as SEQ ID NO:2 or SEQ ID NO:3 or SEQ ID NO:4 or SEQ ID NO:5. An exemplary transmembrane domain sequence is provided as SEQ ID NO:6. An exemplary sequence of the intracellular signaling domain of the 4-1BB protein is provided as SEQ ID NO: 7. An exemplary sequence of the intracellular signaling domain of CD27 is provided as SEQ ID NO:8. An exemplary CD3zeta domain sequence is provided as SEQ ID NO: 9 or SEQ ID NO:10.

In one aspect, the present invention encompasses a recombinant nucleic acid construct comprising a nucleic acid molecule encoding a CAR, wherein the nucleic acid molecule comprises the nucleic acid sequence encoding an anti-BCMA binding domain, e.g., described herein, that is contiguous with and in the same reading frame as a nucleic acid sequence encoding an intracellular signaling domain. In one aspect, the anti-BCMA binding domain is selected from one or more of SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, and SEQ ID NO: 170. In one aspect, the anti-BCMA binding domain comprises SEQ ID NO: 54. In one aspect, the anti-BCMA binding domain comprises SEQ ID NO: 55. In one aspect, the anti-BCMA binding domain comprises SEQ ID NO: 56. In one aspect, the anti-BCMA binding domain comprises SEQ ID NO: 57. In one aspect, the anti-BCMA binding domain comprises SEQ ID NO: 58. In one aspect, the anti-BCMA binding domain comprises SEQ ID NO: 59. In one aspect, the anti-BCMA binding domain comprises SEQ ID NO: 60. In one aspect, the anti-BCMA binding domain comprises SEQ ID NO: 61. In one aspect, the anti-BCMA binding domain comprises SEQ ID NO: 62. In one aspect, the anti-BCMA binding domain comprises SEQ ID NO: 63. In one aspect, the anti-BCMA binding domain comprises SEQ ID NO: 64. In one aspect, the anti-BCMA binding domain comprises SEQ ID NO: 65. In one aspect, the anti-BCMA binding domain comprises SEQ ID NO: 66. In one aspect, the anti-BCMA binding domain comprises SEQ ID NO: 67. In one aspect, the anti-BCMA binding domain comprises SEQ ID NO: 68. In one aspect, the anti-BCMA binding domain comprises SEQ ID NO: 150. In one aspect, the anti-BCMA binding domain comprises SEQ ID NO: 151. In one aspect, the anti-BCMA binding domain comprises SEQ ID NO: 152. In one aspect, the anti-BCMA binding domain comprises SEQ ID NO: 153. In one aspect, the anti-BCMA binding domain comprises SEQ ID NO: 154. In one aspect, the anti-BCMA binding domain comprises SEQ ID NO: 155. In one aspect, the anti-BCMA binding domain comprises SEQ ID NO: 156. In one aspect, the anti-BCMA binding domain comprises SEQ ID NO: 157. In one aspect, the anti-BCMA binding domain comprises SEQ ID NO: 158. In one aspect, the anti-BCMA binding domain comprises SEQ ID NO: 159. In one aspect, the anti-BCMA binding domain comprises SEQ ID NO: 160. In one aspect, the anti-BCMA binding domain comprises SEQ ID NO: 161. In one aspect, the anti-BCMA binding domain comprises SEQ ID NO: 162. In one aspect, the anti-BCMA binding domain comprises SEQ ID NO: 163. In one aspect, the anti-BCMA binding domain comprises SEQ ID NO: 164. In one aspect, the anti-BCMA binding domain comprises SEQ ID NO: 165. In one aspect, the anti-BCMA binding domain comprises SEQ ID NO: 166. In one aspect, the anti-BCMA binding domain comprises SEQ ID NO: 167. In one aspect, the anti-BCMA binding domain comprises SEQ ID NO: 168. In one aspect, the anti-BCMA binding domain comprises SEQ ID NO: 169. In one aspect, the anti-BCMA binding domain comprises SEQ ID NO: 170.

In one aspect, the present invention encompasses a recombinant nucleic acid construct comprising a nucleic acid molecule encoding a CAR, wherein the nucleic acid molecule comprises a nucleic acid sequence encoding an anti-BCMA binding domain selected from one or more of SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, and SEQ ID NO: 170, e.g., wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like. In one aspect the nucleic acid sequence of a CAR construct of the invention is selected from one or more of SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, or SEQ ID NO: 254. In one aspect the nucleic acid sequence of a CAR construct is SEQ ID NO: 114. In one aspect the nucleic acid sequence of a CAR construct is SEQ ID NO: 115. In one aspect the nucleic acid sequence of a CAR construct is SEQ ID NO: 116. In one aspect the nucleic acid sequence of a CAR construct is SEQ ID NO: 117. In one aspect the nucleic acid sequence of a CAR construct is SEQ ID NO: 118. In one aspect the nucleic acid sequence of a CAR construct is SEQ ID NO: 119. In one aspect the nucleic acid sequence of a CAR construct is SEQ ID NO: 120. In one aspect the nucleic acid sequence of a CAR construct is SEQ ID NO: 121. In one aspect the nucleic acid sequence of a CAR construct is SEQ ID NO: 122. In one aspect the nucleic acid sequence of a CAR construct is SEQ ID NO: 123. In one aspect the nucleic acid sequence of a CAR construct is SEQ ID NO: 124. In one aspect the nucleic acid sequence of a CAR construct is SEQ ID NO: 125. In one aspect the nucleic acid sequence of a CAR construct is SEQ ID NO: 126. In one aspect the nucleic acid sequence of a CAR construct is SEQ ID NO: 127. In one aspect the nucleic acid sequence of a CAR construct is SEQ ID NO: 128. In one aspect the nucleic acid sequence of a CAR construct is SEQ ID NO: 234. In one aspect the nucleic acid sequence of a CAR construct is SEQ ID NO: 235. In one aspect the nucleic acid sequence of a CAR construct is SEQ ID NO: 236. In one aspect the nucleic acid sequence of a CAR construct is SEQ ID NO: 237. In one aspect the nucleic acid sequence of a CAR construct is SEQ ID NO: 238. In one aspect the nucleic acid sequence of a CAR construct is SEQ ID NO: 239. In one aspect the nucleic acid sequence of a CAR construct is SEQ ID NO: 240. In one aspect the nucleic acid sequence of a CAR construct is SEQ ID NO: 241. In one aspect the nucleic acid sequence of a CAR construct is SEQ ID NO: 242. In one aspect the nucleic acid sequence of a CAR construct is SEQ ID NO: 243. In one aspect the nucleic acid sequence of a CAR construct is SEQ ID NO: 244. In one aspect the nucleic acid sequence of a CAR construct is SEQ ID NO: 245. In one aspect the nucleic acid sequence of a CAR construct is SEQ ID NO: 246. In one aspect the nucleic acid sequence of a CAR construct is SEQ ID NO: 247. In one aspect the nucleic acid sequence of a CAR construct is SEQ ID NO: 248. In one aspect the nucleic acid sequence of a CAR construct is SEQ ID NO: 249. In one aspect the nucleic acid sequence of a CAR construct is SEQ ID NO: 250. In one aspect the nucleic acid sequence of a CAR construct is SEQ ID NO: 251. In one aspect the nucleic acid sequence of a CAR construct is SEQ ID NO: 252. In one aspect the nucleic acid sequence of a CAR construct is SEQ ID NO: 253. In one aspect the nucleic acid sequence of a CAR construct is SEQ ID NO: 254.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the nucleic acid of interest can be produced synthetically, rather than cloned.

The present invention includes retroviral and lentiviral vector constructs expressing a CAR that can be directly transduced into a cell.

The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:35). RNA so produced can efficiently transfect different kinds of cells. In one embodiment, the template includes sequences for the CAR. In an embodiment, an RNA CAR vector is transduced into a cell, e.g., T cell or NK cell, by electroporation.

Antigen Binding Domain

The CARs of the present invention comprise a target-specific binding domain. The choice of moiety depends upon the type and number of ligands that define the surface of a target cell. For example, the antigen binding domain may be chosen to recognize an antigen that acts as a cell surface marker on target cells associated with a particular disease state.

In one aspect, the CAR-mediated T-cell response can be directed to an antigen of interest by way of engineering an antigen binding domain that specifically binds a desired antigen into the CAR.

In one aspect, the CAR of the present invention comprises a binding domain that specifically binds BCMA. In one aspect, the CAR of the present invention comprises an antigen binding domain that specifically binds human BCMA.

The antigen binding domain can be any protein that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

Thus, in one aspect, the antigen binding domain comprises a human or a humanized antibody or an antibody fragment. In one embodiment, the human anti-BCMA binding domain comprises one or more (e.g., all three) light chain complementary determining region 1 (LC CDR1), light chain complementary determining region 2 (LC CDR2), and light chain complementary determining region 3 (LC CDR3) of a human anti-BCMA binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a human anti-BCMA binding domain described herein, e.g., a human anti-BCMA binding domain comprising one or more, e.g., all three, LC CDRs and one or more, e.g., all three, HC CDRs. In one embodiment, the human anti-BCMA binding domain comprises one or more (e.g., all three) heavy chain complementary determining region 1 (HC CDR1), heavy chain complementary determining region 2 (HC CDR2), and heavy chain complementary determining region 3 (HC CDR3) of a human anti-BCMA binding domain described herein, e.g., the human anti-BCMA binding domain has two variable heavy chain regions, each comprising a HC CDR1, a HC CDR2 and a HC CDR3 described herein. In one embodiment, the human anti-BCMA binding domain comprises a human light chain variable region described herein (e.g., in Table 8) and/or a human heavy chain variable region described herein (e.g., in Table 8). In one embodiment, the human anti-BCMA binding domain comprises a human heavy chain variable region described herein (e.g., in Table 8), e.g., at least two human heavy chain variable regions described herein (e.g., in Table 8). In one embodiment, the anti-BCMA binding domain is a scFv comprising a light chain and a heavy chain of an amino acid sequence of Table 8. In an embodiment, the anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 8, or a sequence with 95-99% identity with an amino acid sequence of Table 15; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 8, or a sequence with 95-99% identity to an amino acid sequence of Table 8.

In one embodiment, the human anti-BCMA binding domain comprises a sequence selected from a group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, and SEQ ID NO: 149, or a sequence with 95-99% identify thereof. In one embodiment, the nucleic acid sequence encoding the human anti-BCMA binding domain comprises a sequence selected from a group consisting of SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, and SEQ ID NO: 170, or a sequence with 95-99% identify thereof. In one embodiment, the human anti-BCMA binding domain is a scFv, and a light chain variable region comprising an amino acid sequence described herein, e.g., in Table 8, is attached to a heavy chain variable region comprising an amino acid sequence described herein, e.g., in Table 8, via a linker, e.g., a linker described herein. In one embodiment, the human anti-BCMA binding domain includes a (Gly$_4$-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region. In one aspect, the antigen binding domain portion comprises one or more sequence selected from SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, and SEQ ID NO: 149. In one aspect the CAR is selected from one or more sequence selected from SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, and SEQ ID NO: 233.

In one embodiment, the anti-BCMA binding domain comprises a light chain variable region described herein (e.g., in Table 10) and/or a heavy chain variable region described herein (e.g., in Table 10). In one embodiment, the encoded humanized anti-BCMA binding domain comprises a light chain variable region provided in SEQ ID NO: 259, SEQ ID NO: 260, SEQ ID NO: 261, SEQ ID NO: 262, and/or a heavy chain variable region provided in SEQ ID NO: 255, SEQ ID NO: 256, SEQ ID NO: 257, SEQ ID NO: 258. In one embodiment, the encoded anti-BCMA binding domain is a scFv comprising a light chain and a heavy chain of an amino acid sequence of Table 10. In an embodiment, the human or humanized anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in SEQ ID NO: 259, SEQ ID NO: 260, SEQ ID NO: 261, SEQ ID NO: 262, or a sequence with 95-99% identity thereof; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in SEQ ID NO: 255, SEQ ID NO: 256, SEQ ID NO: 257, SEQ ID NO: 258, or a sequence with 95-99% identity thereof. In one embodiment, the encoded anti-BCMA binding domain includes a (Gly4-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region.

In one embodiment, the human anti-BCMA binding domain comprises a sequence selected from a group consisting of SEQ ID NO: 263, SEQ ID NO: 264, SEQ ID NO: 265, and SEQ ID NO: 266, or a sequence with 95-99% identity thereof.

In some aspects, a non-human antibody is humanized, where specific sequences or regions of the antibody are modified to increase similarity to an antibody naturally produced in a human or fragment thereof. In one aspect, the antigen binding domain is humanized.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. No. 6,407,213, U.S. Pat. No. 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16):10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example improve, antigen binding. These framework substitutions, e.g., conservative substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323, which are incorporated herein by reference in their entireties.)

A humanized antibody or antibody fragment has one or more amino acid residues remaining in it from a source which is nonhuman. These nonhuman amino acid residues are often referred to as "import" residues, which are typically taken from an "import" variable domain. As provided herein, humanized antibodies or antibody fragments comprise one or more CDRs from nonhuman immunoglobulin molecules and framework regions wherein the amino acid residues comprising the framework are derived completely or mostly from human germline. Multiple techniques for humanization of antibodies or antibody fragments are well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530,101; 5,585,089; 6,548,640, the contents of which are incorporated herein by reference herein in their entirety). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference herein in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (see, e.g., Nicholson et al. Mol. Immun. 34 (16-17): 1157-1165 (1997); Carter et al., Proc. Natl. Acad. Sci. USA, 89:4285 (1992); Presta et al., J. Immunol., 151:2623 (1993), the contents of which are incorporated herein by reference herein in their entirety). In some embodiments, the framework region, e.g., all four framework regions, of the heavy chain variable region are derived from a VH4_4-59 germline sequence. In one embodiment, the framework region can comprise, one, two, three, four or five modifications, e.g., substitutions, e.g., conservative substitutions, e.g., from the amino acid at the corresponding murine sequence. In one embodiment, the framework region, e.g., all four framework regions of the light chain variable region are derived from a VK3_1.25 germline sequence. In one embodiment, the framework region can comprise, one, two, three, four or five modifications, e.g., substitutions, e.g., conservative substitutions, e.g., from the amino acid at the corresponding murine sequence.

In some aspects, the portion of a CAR composition of the invention that comprises an antibody fragment is humanized with retention of high affinity for the target antigen and other favorable biological properties. According to one aspect of the invention, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

A humanized antibody or antibody fragment may retain a similar antigenic specificity as the original antibody, e.g., in the present invention, the ability to bind human BCMA In some embodiments, a humanized antibody or antibody fragment may have improved affinity and/or specificity of binding to human BCMA.

In one embodiment, the humanized anti-BCMA binding domain of the CAR, comprises one or more (e.g., all three) light chain complementary determining region 1 (LC CDR1), light chain complementary determining region 2 (LC CDR2), and light chain complementary determining region 3 (LC CDR3) of a humanized anti-BCMA binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a humanized anti-BCMA binding domain described herein, e.g., a humanized anti-BCMA binding domain comprising one or more, e.g., all three, LC CDRs and one or more, e.g., all three, HC CDRs. In one embodiment, the humanized anti-BCMA binding domain comprises one or more (e.g., all three) heavy chain complementary determining region 1 (HC CDR1), heavy chain complementary determining region 2 (HC CDR2), and heavy chain complementary determining region 3 (HC CDR3) of a humanized anti-BCMA binding domain described herein, e.g., the humanized anti-BCMA binding domain has two variable heavy chain regions, each comprising a HC CDR1, a HC CDR2 and a HC CDR3 described herein. In one embodiment, the humanized anti-BCMA binding domain comprises a humanized light chain variable region described herein (e.g., SEQ ID NO:255 or 257) and/or a human heavy chain variable region described herein (e.g., SEQ ID NO:255 or 257).

In one aspect, the anti-BCMA binding domain is characterized by particular functional features or properties of an antibody or antibody fragment. For example, in one aspect, the portion of a CAR composition of the invention that comprises an antigen binding domain specifically binds human BCMA In one aspect, the antigen binding domain has the same or a similar binding specificity to human BCMA as mouse BCMA. In one aspect, the invention relates to an antigen binding domain comprising an antibody or antibody fragment, wherein the antibody binding domain specifically binds to a BCMA protein or fragment thereof, wherein the antibody or antibody fragment comprises a variable light chain and/or a variable heavy chain that includes an amino acid sequence of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, or SEQ ID NO: 149. In one aspect, the antigen binding domain comprises an amino acid sequence of an scFv selected from SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, or SEQ ID NO: 149. In certain aspects, the scFv is contiguous with and in the same reading frame as a leader sequence. In one aspect the leader sequence is the polypeptide sequence provided as SEQ ID NO:1.

In one aspect, the anti-BCMA binding domain is a fragment, e.g., a single chain variable fragment (scFv). In one aspect, the anti-BCMA binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a BCMA protein with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as $(Gly_4Ser)n$, where n is a positive integer equal to or greater than 1 (SEQ ID NO:25). In one embodiment, the linker can be $(Gly_4Ser)_4$ (SEQ ID NO:27) or $(Gly_4Ser)_3$ (SEQ ID NO:28). Variation in the linker length may retain or enhance activity, giving rise to superior efficacy in activity studies.

Exemplary Human BCMA CAR Constructs and Antigen Binding Domains

Exemplary BCMA CAR constructs disclose herein comprise an scFv (e.g., a scFv as disclosed in Tables 8 or 10, optionally preceded with an optional leader sequence (e.g., SEQ ID NO:1 and SEQ ID NO:12 for exemplary leader amino acid and nucleotide sequences, respectively). The sequences of the scFv fragments (SEQ ID NOs: 39-53, 129-149, or 263-266, not including the optional leader sequence) are provided herein in Tables 8 or 10. The BCMA CAR construct can further include an optional hinge domain, e.g., a CD8 hinge domain (e.g., including the amino acid sequence of SEQ ID NO: 2 or encoded by a nucleic acid sequence of SEQ ID NO:13); a transmembrane domain, e.g., a CD8 transmembrane domain (e.g., including the amino acid sequence of SEQ ID NO: 6 or encoded by the nucleotide sequence of SEQ ID NO: 17); an intracellular domain, e.g., a 4-1BB intracellular domain (e.g., including the amino acid sequence of SEQ ID NO: 7 or encoded by the nucleotide sequence of SEQ ID NO: 18); and a functional signaling domain, e.g., a CD3 zeta domain (e.g., including amino acid sequence of SEQ ID NO: 9 or 10, or encoded by the nucleotide sequence of SEQ ID NO: 20 or 21). In certain embodiments, the domains are contiguous with and in the same reading frame to form a single fusion protein. In other embodiments, the domain are in separate polypeptides, e.g., as in an RCAR molecule as described herein.

In certain embodiments, the full length BCMA CAR molecule includes the amino acid sequence of, or is encoded by the nucleotide sequence of, BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1 provided in Tables 8 or 10, or a sequence substantially (e.g., 95-99%) identical thereto.

In certain embodiments, the BCMA CAR molecule, or the anti-BCMA antigen binding domain, includes the scFv amino acid sequence of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1 provided in Tables 8 or 10 (with or without the leader sequence), or a sequence substantially identical (e.g., 95-99% identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes the heavy chain variable region and/or the light chain variable region of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1 provided in Tables 8 or 10, or a sequence substantially identical (e.g., 95-99% identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 1; and/or one, two or three CDRs from the light chain variable region (e.g., LCDR1, LCDR2 and/or LCDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, provided in Table 2; or a sequence substantially identical (e.g., 95-99% identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 3; and/or one, two or three CDRs from the light chain variable region (e.g., LCDR1, LCDR2 and/or LCDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, provided in Table 4; or a sequence substantially identical (e.g., 95-99% identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 5; and/or one, two or three CDRs from the light chain variable region (e.g., LCDR1, LCDR2 and/or LCDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, provided in Table 6; or a sequence substantially identical (e.g., 95-99% identical, or up to 20, 15, 10, 8, 6, 5, 4, 3, 2, or 1 amino acid changes, e.g., substitutions (e.g., conservative substitutions)) to any of the aforesaid sequences.

The sequences of human CDR sequences of the scFv domains are shown in Tables 1, 3 and 5 for the heavy chain variable domains and in Tables 2, 4 and 6 for the light chain variable domains. "ID" stands for the respective SEQ ID NO for each CDR.

TABLE 1

Heavy Chain Variable Domain CDRs according to the Kabat numbering scheme
(Kabat et al. (1991), "Sequences of Proteins of Immunological Interest," 5th
Ed. Public Health Service, National Institutes of Health, Bethesda, MD)

| Candidate | HCDR1 | ID | HCDR2 | ID | HCDR3 | ID |
|---|---|---|---|---|---|---|
| 139109 | NHGMS | 394 | GIVYSGSTYYAASVKG | 434 | HGGESDV | 474 |
| 139103 | NYAMS | 384 | GISRSGENTYYADSVKG | 424 | SPAHYYGGMDV | 464 |
| 139105 | DYAMH | 385 | GISWNSGSIGYADSVKG | 425 | HSFLAY | 465 |
| 139111 | NHGMS | 386 | GIVYSGSTYYAASVKG | 426 | HGGESDV | 466 |
| 139100 | NFGIN | 387 | WINPKNNNTNYAQKFQG | 427 | GPYYYQSYMDV | 467 |
| 139101 | SDAMT | 388 | VISGSGGTTYYADSVKG | 428 | LDSSGYYYARGPRY | 468 |
| 139102 | NYGIT | 389 | WISAYNGNTNYAQKFQG | 429 | GPYYYYMDV | 469 |
| 139104 | NHGMS | 390 | GIVYSGSTYYAASVKG | 430 | HGGESDV | 470 |
| 139106 | NHGMS | 391 | GIVYSGSTYYAASVKG | 431 | HGGESDV | 471 |
| 139107 | NHGMS | 392 | GIVYSGSTYYAASVKG | 432 | HGGESDV | 472 |
| 139108 | DYYMS | 393 | YISSSGSTIYYADSVKG | 433 | ESGDGMDV | 473 |
| 139110 | DYYMS | 395 | YISSSGNTIYYADSVKG | 435 | STMVREDY | 475 |
| 139112 | NHGMS | 396 | GIVYSGSTYYAASVKG | 436 | HGGESDV | 476 |
| 139113 | NHGMS | 397 | GIVYSGSTYYAASVKG | 437 | HGGESDV | 477 |
| 139114 | NHGMS | 398 | GIVYSGSTYYAASVKG | 438 | HGGESDV | 478 |
| 149362 | SSYYYWG | 399 | SIYYSGSAYYNPSLKS | 439 | HWQEWPDAFDI | 479 |
| 149363 | TSGMCVS | 400 | RIDWDEDKFYSTSLKT | 440 | SGAGGTSATAFDI | 480 |
| 149364 | SYSMN | 401 | SISSSSSYIYYADSVKG | 441 | TIAAVYAFDI | 481 |
| 149365 | DYYMS | 402 | YISSSGSTIYYADSVKG | 442 | DLRGAFDI | 482 |
| 149366 | SHYIH | 403 | MINPSGGVTAYSQTLQG | 443 | EGSGSGWYFDF | 483 |
| 149367 | SGGYYWS | 404 | YIYYSGSTYYNPSLKS | 444 | AGIAARLRGAFDI | 484 |
| 149368 | SYAIS | 405 | GIIPIFGTANYAQKFQG | 445 | RGGYQLLRWDVGLLRSAFDI | 485 |
| 149369 | SNSAAWN | 406 | RTYYRSKWYSFYAISLKS | 446 | SSPEGLFLYWFDP | 486 |
| BCMA_EBB-C1978-A4 | SYAMS | 407 | AISGSGGSTYYADSVKG | 447 | VEGSGSLDY | 487 |
| BCMA_EBB-C1978-G1 | RYPMS | 408 | GISDSGVSTYYADSAKG | 448 | RAGSEASDI | 488 |

TABLE 1-continued

Heavy Chain Variable Domain CDRs according to the Kabat numbering scheme
(Kabat et al. (1991), "Sequences of Proteins of Immunological Interest," 5th
Ed. Public Health Service, National Institutes of Health, Bethesda, MD)

| Candidate | HCDR1 | ID | HCDR2 | ID | HCDR3 | ID |
|---|---|---|---|---|---|---|
| BCMA_EBB-C1979-C1 | SYAMS | 409 | AISGSGGSTYYADSVKG | 449 | ATYKRELRYYYGMDV | 489 |
| BCMA_EBB-C1978-C7 | SYAMS | 410 | AISGSGGSTYYADSVKG | 450 | ATYKRELRYYYGMDV | 490 |
| BCMA_EBB-C1978-D10 | DYAMH | 411 | GISWNSGSIGYADSVKG | 451 | VGKAVPDV | 491 |
| BCMA_EBB-C1979-C12 | DYAMH | 412 | SINWKGNSLAYGDSVKG | 452 | HQGVAYYNYAMDV | 492 |
| BCMA_EBB-C1980-G4 | SYAMS | 413 | AISGSGGSTYYADSVKG | 453 | VVRDGMDV | 493 |
| BCMA_EBB-C1980-D2 | SYAMS | 414 | AISGSGGSTYYADSVKG | 454 | IPQTGTFDY | 494 |
| BCMA_EBB-C1978-A10 | SYAMS | 415 | AISGSGGSTYYADSVKG | 455 | ANYKRELRYYYGMDV | 495 |
| BCMA_EBB-C1978-D4 | SYAMS | 416 | AISGSGGSTYYADSVKG | 456 | ALVGATGAFDI | 496 |
| BCMA_EBB-C1980-A2 | SYAMS | 417 | AISGSGGSTYYADSVKG | 457 | WFGEGFDP | 497 |
| BCMA_EBB-C1981-C3 | SYAMS | 418 | AISGSGGSTYYADSVKG | 458 | VGYDSSGYYRDYYGMDV | 498 |
| BCMA_EBB-C1978-G4 | SYAMS | 419 | AISGSGGSTYYADSVKG | 459 | MGWSSGYLGAFDI | 499 |
| A7D12.2 | NFGMN | 420 | WINTYTGESYFADDFKG | 460 | GEIYYGYDGGFAY | 500 |
| C11D5.3 | DYSIN | 421 | WINTETREPAYAYDFRG | 461 | DYSYAMDY | 501 |
| C12A3.2 | HYSMN | 422 | RINTESGVPIYADDFKG | 462 | DYLYSLDF | 502 |
| C13F12.1 | HYSMN | 423 | RINTETGEPLYADDFKG | 463 | DYLYSCDY | 503 |

TABLE 2

Light Chain Variable Domain CDRs according to the Kabat numbering scheme
(Kabat et al. (1991), "Sequences of Proteins of Immunological Interest," 5th
Ed. Public Health Service, National Institutes of Health, Bethesda, MD)

| Candidate | LCDR1 | ID | LCDR2 | ID | LCDR3 | ID |
|---|---|---|---|---|---|---|
| 139109 | RASQSISSYLN | 514 | AASSLQS | 554 | QQSYSTPYT | 594 |
| 139103 | RASQSISSSFLA | 504 | GASRRAT | 544 | QQYHSSPSWT | 584 |
| 139105 | RSSQSLLHSNGYNYLD | 505 | LGSNRAS | 545 | MQALQTPYT | 585 |
| 139111 | KSSQSLLRNDGKTPLY | 506 | EVSNRFS | 546 | MQNIQFPS | 586 |
| 139100 | RSSQSLLHSNGYNYLN | 507 | LGSKRAS | 547 | MQALQTPYT | 587 |
| 139101 | RASQSISSYLN | 508 | GASTLAS | 548 | QQSYKRAS | 588 |
| 139102 | RSSQSLLYSNGYNYVD | 509 | LGSNRAS | 549 | MQGRQFPYS | 589 |
| 139104 | RASQSVSSNLA | 510 | GASTRAS | 550 | QQYGSSLT | 590 |
| 139106 | RASQSVSSKLA | 511 | GASIRAT | 551 | QQYGSSSWT | 591 |

TABLE 2-continued

Light Chain Variable Domain CDRs according to the Kabat numbering scheme
(Kabat et al. (1991), "Sequences of Proteins of Immunological Interest," 5th
Ed. Public Health Service, National Institutes of Health, Bethesda, MD)

| Candidate | LCDR1 | ID | LCDR2 | ID | LCDR3 | ID |
|---|---|---|---|---|---|---|
| 139107 | RASQSVGSTNLA | 512 | DASNRAT | 552 | QQYGSSPPWT | 592 |
| 139108 | RASQSISSYLN | 513 | AASSLQS | 553 | QQSYTLA | 593 |
| 139110 | KSSESLVHNSGKTYLN | 515 | EVSNRDS | 555 | MQGTHWPGT | 595 |
| 139112 | QASEDINKFLN | 516 | DASTLQT | 556 | QQYESLPLT | 596 |
| 139113 | RASQSVGSNLA | 517 | GASTRAT | 557 | QQYNDWLPVT | 597 |
| 139114 | RASQSIGSSSLA | 518 | GASSRAS | 558 | QQYAGSPPFT | 598 |
| 149362 | KASQDIDDAMN | 519 | SATSPVP | 559 | LQHDNFPLT | 599 |
| 149363 | RASQDIYNNLA | 520 | AANKSQS | 560 | QHYYRFPYS | 600 |
| 149364 | RSSQSLLHSNGYNYLD | 521 | LGSNRAS | 561 | MQALQTPYT | 601 |
| 149365 | GGNNIGTKSVH | 522 | DDSVRPS | 562 | QVWDSDSEHVV | 602 |
| 149366 | SGDGLSKKYVS | 523 | RDKERPS | 563 | QAWDDTTVV | 603 |
| 149367 | RASQGIRNWLA | 524 | AASNLQS | 564 | QKYNSAPFT | 604 |
| 149368 | GGNNIGSKSVH | 525 | GKNNRPS | 565 | SSRDSSGDHLRV | 605 |
| 149369 | QGDSLGNYYAT | 526 | GTNNRPS | 566 | NSRDSSGHHLL | 606 |
| BCMAEBB-C1978-A4 | RASQSVSSAYLA | 527 | GASTRAT | 567 | QHYGSSFNGSSLFT | 607 |
| BCMAEBB-C1978-G1 | RASQSVSNSLA | 528 | DASSRAT | 568 | QQFGTSSGLT | 608 |
| BCMAEBB-C1979-C1 | RASQSVSSSFLA | 529 | GASSRAT | 569 | QQYHSSPSWT | 609 |
| BCMA_EBB-C1978-C7 | RASQSVSTTFLA | 530 | GSSNRAT | 570 | QQYHSSPSWT | 610 |
| BCMAEBB-C1978-D10 | RASQSISSYLN | 531 | AASSLQS | 571 | QQSYSTPYS | 611 |
| BCMAEBB-C1979-C12 | RATQSIGSSFLA | 532 | GASQRAT | 572 | QHYESSPSWT | 612 |
| BCMA_EBB-C1980-G4 | RASQSVSSSYLA | 533 | GASSRAT | 573 | QQYGSPPRFT | 613 |
| BCMA_EBB-C1980-D2 | RASQSVSSSYLA | 534 | GASSRAT | 574 | QHYGSSPSWT | 614 |
| BCMA_EBB-C1978-A10 | RASQRVASNYLA | 535 | GASSRAT | 575 | QHYDSSPSWT | 615 |
| BCMA_EBB-C1978-D4 | RASQSLSSNFLA | 536 | GASNWAT | 576 | QYYGTSPMYT | 616 |
| BCMA_EBB-C1980-A2 | RSSQSLLHSNGYNYLD | 537 | LGSNRAS | 577 | MQALQTPLT | 617 |
| BCMA_EBB-C1981-C3 | RASQSVSSSYLA | 538 | GTSSRAT | 578 | QHYGNSPPKFT | 618 |
| BCMA_EBB-C1978-G4 | RASQSVASSFLA | 539 | GASGRAT | 579 | QHYGGSPRLT | 619 |
| A7D12.2 | RASQDVNTAVS | 540 | SASYRYT | 580 | QQHYSTPWT | 620 |
| C11D5.3 | RASESVSVIGAHLIH | 541 | LASNLET | 581 | LQSRIFPRT | 621 |

TABLE 2-continued

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| C12A3.2 | RASESVTILGSHLIY | 542 | LASNVQT | 582 | LQSRTIPRT | 622 |
| C13F12.1 | RASESVTILGSHLIY | 543 | LASNVQT | 583 | LQSRTIPRT | 623 |

TABLE 3

Heavy Chain Variable Domain CDRs according to the Chothia numbering scheme (Al-Lazikani et al., (1997) JMB 273, 927-948)

| Candidate | HCDR1 | ID | HCDR2 | ID | HCDR3 | ID |
|---|---|---|---|---|---|---|
| 139109 | GFALSNH | 634 | VYSGS | 674 | HGGESDV | 714 |
| 139103 | GFTFSNY | 624 | SRSGEN | 664 | SPAHYYGGMDV | 704 |
| 139105 | GFTFDDY | 625 | SWNSGS | 665 | HSFLAY | 705 |
| 139111 | GFALSNH | 626 | VYSGS | 666 | HGGESDV | 706 |
| 139100 | GYIFDNF | 627 | NPKNNN | 667 | GPYYYQSYMDV | 707 |
| 139101 | GFTFSSD | 628 | SGSGGT | 668 | LDSSGYYYARGPRY | 708 |
| 139102 | GYTFSNY | 629 | SAYNGN | 669 | GPYYYYMDV | 709 |
| 139104 | GFALSNH | 630 | VYSGS | 670 | HGGESDV | 710 |
| 139106 | GFALSNH | 631 | VYSGS | 671 | HGGESDV | 711 |
| 139107 | GFALSNH | 632 | VYSGS | 672 | HGGESDV | 712 |
| 139108 | GFTFSDY | 633 | SSSGST | 673 | ESGDGMDV | 713 |
| 139110 | GFTFSDY | 635 | SSSGNT | 675 | STMVREDY | 715 |
| 139112 | GFALSNH | 636 | VYSGS | 676 | HGGESDV | 716 |
| 139113 | GFALSNH | 637 | VYSGS | 677 | HGGESDV | 717 |
| 139114 | GFALSNH | 638 | VYSGS | 678 | HGGESDV | 718 |
| 149362 | GGSISSSYY | 639 | YYSGS | 679 | HWQEWPDAFDI | 719 |
| 149363 | GFSLRTSGM | 640 | DWDED | 680 | SGAGGTSATAFDI | 720 |
| 149364 | GFTFSSY | 641 | SSSSSY | 681 | TIAAVYAFDI | 721 |
| 149365 | GFTFSDY | 642 | SSSGST | 682 | DLRGAFDI | 722 |
| 149366 | GYTVTSH | 643 | NPSGGV | 683 | EGSGSGWYFDF | 723 |
| 149367 | GGSISSGGY | 644 | YYSGS | 684 | AGIAARLRGAFDI | 724 |
| 149368 | GFTFSSY | 645 | IPIFGT | 685 | RGGYQLLRWDVGLLRSAFDI | 725 |
| 149369 | GDSVSSNSA | 646 | YYRSKWY | 686 | SSPEGLFLYWFDP | 726 |
| BCMA_EBB-C1978-A4 | GFTFSSY | 647 | SGSGGS | 687 | VEGSGSLDY | 727 |
| BCMA_EBB-C1978-G1 | GITFSRY | 648 | SDSGVS | 688 | RAGSEASDI | 728 |
| BCMA_EBB-C1979-C1 | GFTFSSY | 649 | SGSGGS | 689 | ATYKRELRYYYGMDV | 729 |
| BCMA_EBB-C1978-C7 | GFTFSSY | 650 | SGSGGS | 690 | ATYKRELRYYYGMDV | 730 |

TABLE 3-continued

Heavy Chain Variable Domain CDRs according to the Chothia numbering scheme
(Al-Lazikani et al., (1997) JMB 273, 927-948)

| Candidate | HCDR1 | ID | HCDR2 | ID | HCDR3 | ID |
|---|---|---|---|---|---|---|
| BCMA_EBB-C1978-D10 | GFTFDDY | 651 | SWNSGS | 691 | VGKAVPDV | 731 |
| BCMA_EBB-C1979-C12 | GFTFDDY | 652 | NWKGNS | 692 | HQGVAYYNYAMDV | 732 |
| BCMA_EBB-C1980-G4 | GFTFSSY | 653 | SGSGGS | 693 | VVRDGMDV | 733 |
| BCMA_EBB-C1980-D2 | GFTFSSY | 654 | SGSGGS | 694 | IPQTGTFDY | 734 |
| BCMA_EBB-C1978-A10 | GFTFSSY | 655 | SGSGGS | 695 | ANYKRELRYYYGMDV | 735 |
| BCMA_EBB-C1978-D4 | GFSFSSY | 656 | SGSGGS | 696 | ALVGATGAFDI | 736 |
| BCMA_EBB-C1980-A2 | GFTFSSY | 657 | SGSGGS | 697 | WFGEGFDP | 737 |
| BCMA_EBB-C1981-C3 | GFTFSSY | 658 | SGSGGS | 698 | VGYDSSGYYRDYYGMDV | 738 |
| BCMA_EBB-C1978-G4 | GFTFSSY | 659 | SGSGGS | 699 | MGWSSGYLGAFDI | 739 |
| A7D12.2 | GYTFTNF | 660 | NTYTGE | 700 | GEIYYGYDGGFAY | 740 |
| C11D5.3 | GYTFTDY | 661 | NTETRE | 701 | DYSYAMDY | 741 |
| C12A3.2 | GYTFRHY | 662 | NTESGV | 702 | DYLYSLDF | 742 |
| C13F12.1 | GYTFTHY | 663 | NTETGE | 703 | DYLYSCDY | 743 |

TABLE 4

Light Chain Variable Domain CDRs according to the Chothia numbering scheme
(Al-Lazikani et al., (1997) JMB 273,927-948)

| Candidate | LCDR1 | ID | LCDR2 | ID | LCDR3 | ID |
|---|---|---|---|---|---|---|
| 139109 | SQSISSY | 754 | AAS | 794 | SYSTPY | 834 |
| 139103 | SQSISSSF | 744 | GAS | 784 | YHSSPSW | 824 |
| 139105 | SQSLLHSNGYNY | 745 | LGS | 785 | ALQTPY | 825 |
| 139111 | SQSLLRNDGKTP | 746 | EVS | 786 | NIQFP | 826 |
| 139100 | SQSLLHSNGYNY | 747 | LGS | 787 | ALQTPY | 827 |
| 139101 | SQSISSY | 748 | GAS | 788 | SYKRA | 828 |
| 139102 | SQSLLYSNGYNY | 749 | LGS | 789 | GRQFPY | 829 |
| 139104 | SQSVSSN | 750 | GAS | 790 | YGSSL | 830 |
| 139106 | SQSVSSK | 751 | GAS | 791 | YGSSSW | 831 |
| 139107 | SQSVGSTN | 752 | DAS | 792 | YGSSPPW | 832 |
| 139108 | SQSISSY | 753 | AAS | 793 | SYTL | 833 |
| 139110 | SESLVHNSGKTY | 755 | EVS | 795 | GTHWPG | 835 |
| 139112 | SEDINKF | 756 | DAS | 796 | YESLPL | 836 |
| 139113 | SQSVGSN | 757 | GAS | 797 | YNDWLPV | 837 |
| 139114 | SQSIGSSS | 758 | GAS | 798 | YAGSPPF | 838 |

TABLE 4-continued

Light Chain Variable Domain CDRs according to the Chothia numbering scheme
(Al-Lazikani et al., (1997) JMB 273,927-948)

| Candidate | LCDR1 | ID | LCDR2 | ID | LCDR3 | ID |
|---|---|---|---|---|---|---|
| 149362 | SQDIDDA | 759 | SAT | 799 | HDNFPL | 839 |
| 149363 | SQDIYNN | 760 | AAN | 800 | YRRFPY | 840 |
| 149364 | SQSLLHSNGYNY | 761 | LGS | 801 | ALQTPY | 841 |
| 149365 | NNIGTKS | 762 | DDS | 802 | WDSDSEHV | 842 |
| 149366 | DGLSKKY | 763 | RDK | 803 | WDDTTV | 843 |
| 149367 | SQGIRNW | 764 | AAS | 804 | YNSAPF | 844 |
| 149368 | NNIGSKS | 765 | GKN | 805 | RDSSGDHLR | 845 |
| 149369 | DSLGNYY | 766 | GTN | 806 | RDSSGHHL | 846 |
| BCMA_EBB-C1978-A4 | SQSVSSAY | 767 | GAS | 807 | YGSSFNGSSLF | 847 |
| BCMA_EBB-C1978-G1 | SQSVSNS | 768 | DAS | 808 | FGTSSGL | 848 |
| BCMA_EBB-C1979-C1 | SQSVSSSF | 769 | GAS | 809 | YHSSPSW | 849 |
| BCMA_EBB-C1978-C7 | SQSVSTTF | 770 | GSS | 810 | YHSSPSW | 850 |
| BCMA_EBB-C1978-D10 | SQSISSY | 771 | AAS | 811 | SYSTPY | 851 |
| BCMA_EBB-C1979-C12 | TQSIGSSF | 772 | GAS | 812 | YESSPSW | 852 |
| BCMA_EBB-C1980-G4 | SQSVSSSY | 773 | GAS | 813 | YGSPPRF | 853 |
| BCMA_EBB-C1980-D2 | SQSVSSSY | 774 | GAS | 814 | YGSSPSW | 854 |
| BCMA_EBB-C1978-A10 | SQRVASNY | 775 | GAS | 815 | YDSSPSW | 855 |
| BCMA_EBB-C1978-D4 | SQSLSSNF | 776 | GAS | 816 | YGTSPMY | 856 |
| BCMA_EBB-C1980-A2 | SQSLLHSNGYNY | 777 | LGS | 817 | ALQTPL | 857 |
| BCMA_EBB-C1981-C3 | SQSVSSSY | 778 | GTS | 818 | YGNSPPKF | 858 |
| BCMA_EBB-C1978-G4 | SQSVASSF | 779 | GAS | 819 | YGGSPRL | 859 |
| A7D12.2 | SQDVNTA | 780 | SAS | 820 | HYSTPW | 860 |
| C11D5.3 | SESVSVIGAHL | 781 | LAS | 821 | SRIFPR | 861 |
| C12A3.2 | SESVTILGSHL | 782 | LAS | 822 | SRTIPR | 862 |
| C13F12.1 | SESVTILGSHL | 783 | LAS | 823 | SRTIPR | 863 |

TABLE 5

Heavy Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273,927-948).

| Candidate | HCDR1 | ID | HCDR2 | ID | HCDR3 | ID |
|---|---|---|---|---|---|---|
| 139109 | GFALSNHGMS | 874 | GIVYSGSTYYAASVKG | 914 | HGGESDV | 954 |
| 139103 | GFTFSNYAMS | 864 | GISRSGENTYYADSVKG | 904 | SPAHYYGGMDV | 944 |
| 139105 | GFTFDDYAMH | 865 | GISWNSGSIGYADSVKG | 905 | HSFLAY | 945 |
| 139111 | GFALSNHGMS | 866 | GIVYSGSTYYAASVKG | 906 | HGGESDV | 946 |
| 139100 | GYIFDNFGIN | 867 | WINPKNNNTNYAQKFQG | 907 | GPYYYQSYMDV | 947 |
| 139101 | GFTFSSDAMT | 868 | VISGSGGTTYYADSVKG | 908 | LDSSGYYYARGPRY | 948 |
| 139102 | GYTFSNYGIT | 869 | WISAYNGNTNYAQKFQG | 909 | GPYYYYMDV | 949 |
| 139104 | GFALSNHGMS | 870 | GIVYSGSTYYAASVKG | 910 | HGGESDV | 950 |
| 139106 | GFALSNHGMS | 871 | GIVYSGSTYYAASVKG | 911 | HGGESDV | 951 |
| 139107 | GFALSNHGMS | 872 | GIVYSGSTYYAASVKG | 912 | HGGESDV | 952 |
| 139108 | GFTFSDYYMS | 873 | YISSSGSTIYYADSVKG | 913 | ESGDGMDV | 953 |
| 139110 | GFTFSDYYMS | 875 | YISSSGNTIYYADSVKG | 915 | STMVREDY | 955 |
| 139112 | GFALSNHGMS | 876 | GIVYSGSTYYAASVKG | 916 | HGGESDV | 956 |
| 139113 | GFALSNHGMS | 877 | GIVYSGSTYYAASVKG | 917 | HGGESDV | 957 |
| 139114 | GFALSNHGMS | 878 | GIVYSGSTYYAASVKG | 918 | HGGESDV | 958 |
| 149362 | GGSISSSYYYWG | 879 | SIYYSGSAYYNPSLKS | 919 | HWQEWPDAFDI | 959 |
| 149363 | GFSLRTSGMCVS | 880 | RIDWDEDKFYSTSLKT | 920 | SGAGGTSATAFDI | 960 |
| 149364 | GFTFSSYSMN | 881 | SISSSSSYIYYADSVKG | 921 | TIAAVYAFDI | 961 |
| 149365 | GFTFSDYYMS | 882 | YISSSGSTIYYADSVKG | 922 | DLRGAFDI | 962 |
| 149366 | GYTVTSHYIH | 883 | MINPSGGVTAYSQTLQG | 923 | EGSGSGWYFDF | 963 |
| 149367 | GGSISSGGYYWS | 884 | YIYYSGSTYYNPSLKS | 924 | AGIAARLRGAFDI | 964 |
| 149368 | GGTFSSYAIS | 885 | GIIPIFGTANYAQKFQG | 925 | RGGYQLLRWDVGLLRSAFDI | 965 |
| 149369 | GDSVSSNSAAWN | 886 | RTYYRSKWYSFYAISLKS | 926 | SSPEGLFLYWFDP | 966 |
| BCMA_EBB-C1978-A4 | GFTFSSYAMS | 887 | AISGSGGSTYYADSVKG | 927 | VEGSGSLDY | 967 |

TABLE 5-continued

Heavy Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273,927-948).

| Candidate | HCDR1 | ID | HCDR2 | ID | HCDR3 | ID |
|---|---|---|---|---|---|---|
| BCMA_EBB-C1978-G1 | GITFSRYPMS | 888 | GISDSGVSTYYADSAKG | 928 | RAGSEASDI | 968 |
| BCMA_EBB-C1979-C1 | GFTFSSYAMS | 889 | AISGSGGSTYYADSVKG | 929 | ATYKRELRYYYGMDV | 969 |
| BCMA_EBB-C1978-C7 | GFTFSSYAMS | 890 | AISGSGGSTYYADSVKG | 930 | ATYKRELRYYYGMDV | 970 |
| BCMA_EBB-C1978-D10 | GFTFDDYAMH | 891 | GISWNSGSIGYADSVKG | 931 | VGKAVPDV | 971 |
| BCMA_EBB-C1979-C12 | GFTFDDYAMH | 892 | SINWKGNSLAYGDSVKG | 932 | HQGVAYYNYAMDV | 972 |
| BCMA_EBB-C1980-G4 | GFTFSSYAMS | 893 | AISGSGGSTYYADSVKG | 933 | VVRDGMDV | 973 |
| BCMA_EBB-C1980-D2 | GFTFSSYAMS | 894 | AISGSGGSTYYADSVKG | 934 | IPQTGTFDY | 974 |
| BCMA_EBB-C1978-A10 | GFTFSSYAMS | 895 | AISGSGGSTYYADSVKG | 935 | ANYKRELRYYYGMDV | 975 |
| BCMA_EBB-C1978-D4 | GFSFSSYAMS | 896 | AISGSGGSTYYADSVKG | 936 | ALVGATGAFDI | 976 |
| BCMA_EBB-C1980-A2 | GFTFSSYAMS | 897 | AISGSGGSTYYADSVKG | 937 | WFGEGFDP | 977 |
| BCMA_EBB-C1981-C3 | GFTFSSYAMS | 898 | AISGSGGSTYYADSVKG | 938 | VGYDSSGYYRDYYGMDV | 978 |
| BCMA_EBB-C1978-G4 | GFTFSSYAMS | 899 | AISGSGGSTYYADSVKG | 939 | MGWSSGYLGAFDI | 979 |
| A7D12.2 | GYTFTNFGMN | 900 | WINTYTGESYFADDFKG | 940 | GEIYYGYDGGFAY | 980 |
| C11D5.3 | GYTFTDYSIN | 901 | WINTETREPAYAYDFRG | 941 | DYSYAMDY | 981 |
| C12A3.2 | GYTFRHYSMN | 902 | RINTESGVPIYADDFKG | 942 | DYLYSLDF | 982 |
| C13F12.1 | GYTFTHYSMN | 903 | RINTETGEPLYADDFKG | 943 | DYLYSCDY | 983 |

TABLE 6

Light Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273,927-948).

| Candidate | LCDR1 | ID | LCDR2 | ID | LCDR3 | ID |
|---|---|---|---|---|---|---|
| 139109 | RASQSISSYLN | 994 | AASSLQS | 1034 | QQSYSTPYT | 1074 |
| 139103 | RASQSISSSFLA | 984 | GASRRAT | 1024 | QQYHSSPSWT | 1064 |
| 139105 | RSSQSLLHSNGYNYLD | 985 | LGSNRAS | 1025 | MQALQTPYT | 1065 |
| 139111 | KSSQSLLRNDGKTPLY | 986 | EVSNRFS | 1026 | MQNIQFPS | 1066 |
| 139100 | RSSQSLLHSNGYNYLN | 987 | LGSKRAS | 1027 | MQALQTPYT | 1067 |
| 139101 | RASQSISSYLN | 988 | GASTLAS | 1028 | QQSYKRAS | 1068 |
| 139102 | RSSQSLLYSNGYNYVD | 989 | LGSNRAS | 1029 | MQGRQFPYS | 1069 |

TABLE 6-continued

Light Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273, 927-948).

| Candidate | LCDR1 | ID | LCDR2 | ID | LCDR3 | ID |
|---|---|---|---|---|---|---|
| 139104 | RASQSVSSNLA | 990 | GASTRAS | 1030 | QQYGSSLT | 1070 |
| 139106 | RASQSVSSKLA | 991 | GASIRAT | 1031 | QQYGSSSWT | 1071 |
| 139107 | RASQSVGSTNLA | 992 | DASNRAT | 1032 | QQYGSSPPWT | 1072 |
| 139108 | RASQSISSYLN | 993 | AASSLQS | 1033 | QQSYTLA | 1073 |
| 139110 | KSSESLVHNSGKTYLN | 995 | EVSNRDS | 1035 | MQGTHWPGT | 1075 |
| 139112 | QASEDINKFLN | 996 | DASTLQT | 1036 | QQYESLPLT | 1076 |
| 139113 | RASQSVGSNLA | 997 | GASTRAT | 1037 | QQYNDWLPVT | 1077 |
| 139114 | RASQSIGSSSLA | 998 | GASSRAS | 1038 | QQYAGSPPFT | 1078 |
| 149362 | KASQDIDDAMN | 999 | SATSPVP | 1039 | LQHDNFPLT | 1079 |
| 149363 | RASQDIYNNLA | 1000 | AANKSQS | 1040 | QHYYRFPYS | 1080 |
| 149364 | RSSQSLLHSNGYNYLD | 1001 | LGSNRAS | 1041 | MQALQTPYT | 1081 |
| 149365 | GGNNIGTKSVH | 1002 | DDSVRPS | 1042 | QVWDSDSEHVV | 1082 |
| 149366 | SGDGLSKKYVS | 1003 | RDKERPS | 1043 | QAWDDTTVV | 1083 |
| 149367 | RASQGIRNWLA | 1004 | AASNLQS | 1044 | QKYNSAPFT | 1084 |
| 149368 | GGNNIGSKSVH | 1005 | GKNNRPS | 1045 | SSRDSSGDHLRV | 1085 |
| 149369 | QGDSLGNYYAT | 1006 | GTNNRPS | 1046 | NSRDSSGHHLL | 1086 |
| BCMA_EBB-C1978-A4 | RASQSVSSAYLA | 1007 | GASTRAT | 1047 | QHYGSSFNGSSLFT | 1087 |
| BCMA_EBB-C1978-G1 | RASQSVSNSLA | 1008 | DASSRAT | 1048 | QQFGTSSGLT | 1088 |
| BCMA_EBB-C1979-C1 | RASQSVSSSFLA | 1009 | GASSRAT | 1049 | QQYHSSPSWT | 1089 |
| BCMA_EBB-C1978-C7 | RASQSVSTTFLA | 1010 | GSSNRAT | 1050 | QQYHSSPSWT | 1090 |
| BCMA_EBB-C1978-D10 | RASQSISSYLN | 1011 | AASSLQS | 1051 | QQSYSTPYS | 1091 |
| BCMA_EBB-C1979-C12 | RATQSIGSSFLA | 1012 | GASQRAT | 1052 | QHYESSPSWT | 1092 |
| BCMA_EBB-C1980-G4 | RASQSVSSSYLA | 1013 | GASSRAT | 1053 | QQYGSPPRFT | 1093 |
| BCMA_EBB-C1980-D2 | RASQSVSSSYLA | 1014 | GASSRAT | 1054 | QHYGSSPSWT | 1094 |
| BCMA_EBB-C1978-A10 | RASQRVASNYLA | 1015 | GASSRAT | 1055 | QHYDSSPSWT | 1095 |
| BCMA_EBB-C1978-D4 | RASQSLSSNFLA | 1016 | GASNWAT | 1056 | QYYGTSPMYT | 1096 |
| BCMA_EBB-C1980-A2 | RSSQSLLHSNGYNYLD | 1017 | LGSNRAS | 1057 | MQALQTPLT | 1097 |
| BCMA_EBB-C1981-C3 | RASQSVSSSYLA | 1018 | GTSSRAT | 1058 | QHYGNSPPKFT | 1098 |

TABLE 6-continued

Light Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273,927-948).

| Candidate | LCDR1 | ID | LCDR2 | ID | LCDR3 | ID |
| --- | --- | --- | --- | --- | --- | --- |
| BCMA EBB-C1978-G4 | RASQSVASSFLA | 1019 | GASGRAT | 1059 | QHYGGSPRLT | 1099 |
| A7D12.2 | RASQDVNTAVS | 1020 | SASYRYT | 1060 | QQHYSTPWT | 1100 |
| C11D5.3 | RASESVSVIGAHLIH | 1021 | LASNLET | 1061 | LQSRIFPRT | 1101 |
| C12A3.2 | RASESVTILGSHLIY | 1022 | LASNVQT | 1062 | LQSRTIPRT | 1102 |
| C13F12.1 | RASESVTILGSHLIY | 1023 | LASNVQT | 1063 | LQSRTIPRT | 1103 |

In certain embodiments, the CAR molecule described herein (e.g., the CAR nucleic acid or the CAR polypeptide) or a BCMA binding domain includes:
(1) one, two, or three light chain (LC) CDRs chosen from one of the following:
(i) a LC CDR1 of SEQ ID NO: 504, LC CDR2 of SEQ ID NO: 544 and LC CDR3 of SEQ ID NO: 584 of BCMA-4 CAR (139103);
(ii) a LC CDR1 of SEQ ID NO: 514, LC CDR2 of SEQ ID NO: 554 and LC CDR3 of SEQ ID NO: 594 of BCMA-10 CAR (139109);
(iii) a LC CDR1 of SEQ ID NO: 516, LC CDR2 of SEQ ID NO: 556 and LC CDR3 of SEQ ID NO: 596 of BCMA-13 CAR (139112); or
(iv) a LC CDR1 of SEQ ID NO: 518, LC CDR2 of SEQ ID NO: 558 and LC CDR3 of SEQ ID NO: 598 of BCMA-15 CAR (139114), and/or
(2) one, two, or three heavy chain (HC) CDRs from one of the following:
(i) a HC CDR1 of SEQ ID NO: 384, HC CDR2 of SEQ ID NO: 424 and HC CDR3 of SEQ ID NO: 464 of BCMA-4 CAR (139103);
(ii) a HC CDR1 of SEQ ID NO: 394, HC CDR2 of SEQ ID NO: 434 and HC CDR3 of SEQ ID NO: 474 of BCMA-10 CAR (139109);
(iii) a HC CDR1 of SEQ ID NO: 396, HC CDR2 of SEQ ID NO: 436 and HC CDR3 of SEQ ID NO: 476 of BCMA-13 CAR (139112); or
(iv) a HC CDR1 of SEQ ID NO: 398, HC CDR2 of SEQ ID NO: 438 and HC CDR3 of SEQ ID NO: 478 of BCMA-15 (139114).

In certain embodiments, the CAR molecule described herein (e.g., the CAR nucleic acid or the CAR polypeptide) includes:
(1) one, two, or three light chain (LC) CDRs chosen from one of the following:
(i) a LC CDR1 of SEQ ID NO: 744, LC CDR2 of SEQ ID NO: 784 and LC CDR3 of SEQ ID NO: 824 of BCMA-4 CAR (139103);
(ii) a LC CDR1 of SEQ ID NO: 754, LC CDR2 of SEQ ID NO: 794 and LC CDR3 of SEQ ID NO: 834 of BCMA-10 CAR (139109);
(iii) a LC CDR1 of SEQ ID NO: 756, LC CDR2 of SEQ ID NO: 796 and LC CDR3 of SEQ ID NO: 836 of BCMA-13 CAR (139112); or
(iv) a LC CDR1 of SEQ ID NO: 758, LC CDR2 of SEQ ID NO: 798 and LC CDR3 of SEQ ID NO: 838 of BCMA-15 CAR (139114); and/or
(2) one, two, or three heavy chain (HC) CDRs chosen from one of the following:
(i) a HC CDR1 of SEQ ID NO: 624, HC CDR2 of SEQ ID NO: 664 and HC CDR3 of SEQ ID NO: 704 of BCMA-4 CAR (139103);
(ii) a HC CDR1 of SEQ ID NO: 634, HC CDR2 of SEQ ID NO: 674 and HC CDR3 of SEQ ID NO: 714 of BCMA-10 CAR (139109);
(iii) a HC CDR1 of SEQ ID NO: 636, HC CDR2 of SEQ ID NO: 676 and HC CDR3 of SEQ ID NO: 716 of BCMA-13 CAR (139112); or
(iv) a HC CDR1 of SEQ ID NO: 638, HC CDR2 of SEQ ID NO: 678 and HC CDR3 of SEQ ID NO: 718 of BCMA-15 CAR (139114).

In certain embodiments, the CAR molecule described herein (e.g., the CAR nucleic acid or the CAR polypeptide) includes:
(1) one, two, or three light chain (LC) CDRs chosen from one of the following:
(i) a LC CDR1 of SEQ ID NO: 984 LC CDR2 of SEQ ID NO: 1024 and LC CDR3 of SEQ ID NO: 1064 of BCMA-4 CAR (139103);
(ii) a LC CDR1 of SEQ ID NO: 994, LC CDR2 of SEQ ID NO: 1034 and LC CDR3 of SEQ ID NO: 1074 of BCMA-10 CAR (139109);
(iii) a LC CDR1 of SEQ ID NO: 996, LC CDR2 of SEQ ID NO: 1036 and LC CDR3 of SEQ ID NO: 1076 of BCMA-13 CAR (139112); or
(iv) a LC CDR1 of SEQ ID NO: 998, LC CDR2 of SEQ ID NO: 1038 and LC CDR3 of SEQ ID NO: 1078 of BCMA-15 CAR (139114); and/or
(2) one, two, or three heavy chain (HC) CDRs chosen from one of the following:
(i) a HC CDR1 of SEQ ID NO: 864, HC CDR2 of SEQ ID NO: 904 and HC CDR3 of SEQ ID NO: 944 of BCMA-4 CAR (139103);
(ii) a HC CDR1 of SEQ ID NO: 874, HC CDR2 of SEQ ID NO: 914 and HC CDR3 of SEQ ID NO: 954 of BCMA-10 CAR (139109);
(iii) a HC CDR1 of SEQ ID NO: 876, HC CDR2 of SEQ ID NO: 916 and HC CDR3 of SEQ ID NO: 956 of BCMA-13 CAR (139112);
(iv) a HC CDR1 of SEQ ID NO: 878, HC CDR2 of SEQ ID NO: 918 and HC CDR3 of SEQ ID NO: 958 of BCMA-15 CAR (139114).

In embodiments, anti-BCMA CAR constructs, e.g., human or humanized anti-BCMA CAR constructs, are generated using a method described herein, e.g., as described in Example 4. Exemplary anti-BCMA scFvs include but are not limited to BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, and BCMA-15. The sequences of human anti-BCMA scFv fragments (SEQ ID NOS: 39-52), are provided in Table 8 (and the name designations are provided in Table 7).

In embodiments, full BCMA CAR constructs (e.g., SEQ ID NOs: 99-113) are generated using scFv fragments, e.g., the human scFv fragments (e.g., SEQ ID NOs: 39-52), in combination with additional sequences, such as those shown below.

It is noted that the scFv fragments described herein, e.g., in Tables 8 and 10 or in SEQ ID NOS: 39-53, 129-149, 263-266, 271 or 273, without a leader sequence (e.g., without the amino acid sequence of SEQ ID NO: 1 or the nucleotide sequence of SEQ ID NO:12), are encompassed by the present invention. In other embodiments, scFv fragments described herein, e.g., in Tables 8 and 10 or in SEQ ID NOS: 39-53, 129-149, 263-266, 271 or 273 with a leader sequence (e.g., without the amino acid sequence of SEQ ID NO: 1 or the nucleotide sequence of SEQ ID NO:12), are also encompassed by the present invention.

```
leader (amino acid sequence)
                                     (SEQ ID NO: 1)
MALPVTALLLPLALLLHAARP leader (nucleic acid sequence)
                                    (SEQ ID NO: 12)
ATGGCCCTGCCTGTGACAGCCCTGCTGCTGCCTCTGGCTCTGCTGCTGCA

TGCCGCTAGACCC

CD8 hinge (amino acid sequence)
                                     (SEQ ID NO: 2)
TTTPAPRPPTPAPTIASQPLSLRPEACRPAAGGAVHTRGLDFACD CD8 hinge (nucleic acid sequence)
                                    (SEQ ID NO: 13)
ACCACGACGCCAGCGCCGCGACCACCAACACCGGCGCCCACCATCGCGTC

GCAGCCCCTGTCCCTGCGCCCAGAGGCGTGCCGGCCAGCGGCGGGGGGCG

CAGTGCACACGAGGGGGCTGGACTTCGCCTGTGAT

CD8 transmembrane (amino acid sequence)
                                     (SEQ ID NO: 6)
IYIWAPLAGTCGVLLLSLVITLYC CD8 transmembrane (nucleic acid sequence)
                                    (SEQ ID NO: 17)
ATCTACATCTGGGCGCCCTTGGCCGGGACTTGTGGGGTCCTTCTCCTGTC

ACTGGTTATCACCCTTTACTGC 4-1BB Intracellular domain (amino acid sequence)
                                     (SEQ ID NO: 7)
KRGRKKLLYIFKQPFMRPVQTTQEEDGCSCRFPEEEEGGCEL 4-1BB Intracellular domain (nucleic acid sequence)
                                    (SEQ ID NO: 18)
AAACGGGGCAGAAAGAAACTCCTGTATATATTCAAACAACCATTTATGAG

ACCAGTACAAACTACTCAAGAGGAAGATGGCTGTAGCTGCCGATTTCCAG

AAGAAGAAGAAGGAGGATGTGAACTG

CD28 Intracellular domain (amino acid sequence)
                                  (SEQ ID NO: 1104)
RSKRSRLLHSDYMNMTPRRPGPTRKHYQPYAPPRDFAAYRS (SEQ ID

NO: 1104)

CD28 Intracellular domain (nucleotide sequence)
                                  (SEQ ID NO: 1105)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC (SEQ ID NO: 1105)

ICOS Intracellular domain (amino acid sequence)
                                  (SEQ ID NO: 1106)
T K K K Y S S S V H D P N G E Y M F M R A V N T A

K K S R L T D V T L (SEQ ID NO: 1106)

ICOS Intracellular domain (nucleotide sequence)
                                  (SEQ ID NO: 1107)
ACAAAAAAGAAGTATTCATCCAGTGTGCACGACCCTAACGGTGAATACAT

GTTCATGAGAGCAGTGAACACAGCCAAAAAATCCAGACTCACAGATGTGA

CCCTA (SEQ ID NO: 1107)

CD3 zeta domain (amino acid sequence)
                                     (SEQ ID NO: 9)
RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence)
                                    (SEQ ID NO: 20)
AGAGTGAAGTTCAGCAGGAGCGCAGACGCCCCCGCGTACAAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

CD3 zeta domain (amino acid sequence; NCBI
Reference Sequence NM_000734.3)
                                    (SEQ ID NO: 10)
RVKFSRSADAPAYQQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence; NCBI Reference
Sequence NM_000734.3);
                                    (SEQ ID NO: 21)
AGAGTGAAGTTCAGCAGGAGCGCAGACGCCCCCGCGTACCAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

IgG4 Hinge (amino acid sequence)
                                    (SEQ ID NO: 36)
ESKYGPPCPPCPAPEFLGGPSVFLFPPKPKDTLMISRTPEVTCVVVDVSQ

EDPEVQFNVVYVDGVEVHNAKTKPREEQFNSTYRVVSVLTVLHQDWLNGK

EYKCKVSNKGLPSSIEKTISKAKGQPREPQVYTLPPSQEEMTKNQVSLTC
```

LVKGFYPSDIAVEWESNGQPENNYKTTPPVLDSDGSFFLYSRLTVDKSRW

QEGNVFSCSVMHEALHNHYTQKSLSLSLGKM

IgG4 Hinge (nucleotide sequence)
(SEQ ID NO: 37)
GAGAGCAAGTACGGCCCTCCCTGCCCCCCTTGCCCTGCCCCCGAGTTCCT

GGGCGGACCCAGCGTGTTCCTGTTCCCCCCCAAGCCCAAGGACACCCTGA

TGATCAGCCGGACCCCCGAGGTGACCTGTGTGGTGGTGGACGTGTCCCAG

GAGGACCCCGAGGTCCAGTTCAACTGGTACGTGGACGGCGTGGAGGTGCA

CAACGCCAAGACCAAGCCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG

GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG

In embodiments, the CAR scFv fragments are cloned into lentiviral vectors to create a full length CAR construct in a single coding frame, and using a promoter, e.g., EF1 alpha promoter, for expression (SEQ ID NO: 11).

EF1 alpha promoter
CGTGAGGCTCCGGTGCCCGTCAGTGGGCAGAGCGCACATCGCCCACAGTC

CCCGAGAAGTTGGGGGGAGGGGTCGGCAATTGAACCGGTGCCTAGAGAAG

GTGGCGCGGGGTAAACTGGGAAAGTGATGTCGTGTACTGGCTCCGCCTTT

TTCCCGAGGGTGGGGGAGAACCGTATATAAGTGCAGTAGTCGCCGTGAAC

GTTCTTTTTCGCAACGGGTTTGCCGCCAGAACACAGGTAAGTGCCGTGTG

TGGTTCCCGCGGGCCTGGCCTCTTTACGGGTTATGGCCCTTGCGTGCCTT

GAATTACTTCCACCTGGCTGCAGTACGTGATTCTTGATCCCGAGCTTCGG

GTTGGAAGTGGGTGGGAGAGTTCGAGGCCTTGCGCTTAAGGAGCCCCTTC

GCCTCGTGCTTGAGTTGAGGCCTGGCCTGGGCGCTGGGGCCGCCGCGTGC

GAATCTGGTGGCACCTTCGCGCCTGTCTCGCTGCTTTCGATAAGTCTCTA

GCCATTTAAAATTTTTGATGACCTGCTGCGACGCTTTTTTTCTGGCAAGA

TAGTCTTGTAAATGCGGGCCAAGATCTGCACACTGGTATTTCGGTTTTTG

GGGCCGCGGGCGGCGACGGGGCCCGTGCGTCCCAGCGCACATGTTCGGCG

AGGCGGGGCCTGCGAGCGCGGCCACCGAGAATCGGACGGGGGTAGTCTCA

AGCTGGCCGGCCTGCTCTGGTGCCTGGCCTCGCGCCGCCGTGTATCGCCC

CGCCCTGGGCGGCAAGGCTGGCCCGGTCGGCACCAGTTGCGTGAGCGGAA

AGATGGCCGCTTCCCGGCCCTGCTGCAGGGAGCTCAAATGGAGGACGCG

GCGCTCGGGAGAGCGGGCGGGTGAGTCACCCACACAAAGGAAAAGGGCCT

TTCCGTCCTCAGCCGTCGCTTCATGTGACTCCACGGAGTACCGGGCGCCG

TCCAGGCACCTCGATTAGTTCTCGAGCTTTTGGAGTACGTCGTCTTTAGG

TTGGGGGGAGGGGTTTTATGCGATGGAGTTTCCCCACACTGAGTGGGTGG

AGACTGAAGTTAGGCCAGCTTGGCACTTGATGTAATTCTCCTTGGAATTT

GCCCTTTTTGAGTTTGGATCTTGGTTCATTCTCAAGCCTCAGACAGTGGT

TCAAAGTTTTTTTCTTCCATTTCAGGTGTCGTGA (SEQ ID NO: 11).

Gly/Ser (SEQ ID NO: 25)
GGGGS

Gly/Ser (SEQ ID NO: 26): This sequence may encompass 1-6 "Gly Gly Gly Gly Ser" repeating units
GGGGSGGGGS GGGGSGGGGS GGGGSGGGGS Gly/Ser (SEQ ID NO: 27)
GGGGSGGGGS GGGGSGGGGS Gly/Ser (SEQ ID NO: 28)
GGGGSGGGGS GGGGS Gly/Ser (SEQ ID NO: 29)
GGGS PolyA: (A)$_{5000}$ (SEQ ID NO: 30)

PolyA: (T)$_{100}$ (SEQ ID NO: 31)

PolyA: (T)$_{5000}$ (SEQ ID NO: 32)

PolyA: (A)$_{5000}$ (SEQ ID NO: 33)

PolyA: (A)$_{400}$ (SEQ ID NO: 34)

PolyA: (A)$_{2000}$ (SEQ ID NO: 35)

Gly/Ser (SEQ ID NO:38): This sequence may encompass 1-10 "Gly Gly Gly Ser" repeating units
GGGSGGGSGG GSGGGSGGGS GGGSGGGSGG GSGGGSGGGS The amino acid and nucleic acid sequences of exemplary BCMA scFv domains and exemplary BCMA CAR molecules are provided in Table 8.

Table 7 below designates the nicknames for the BCMA CAR constructs with respect to the DNA ID number, also listed in Table 8.

TABLE 7

| CAR construct IDs | | |
|---|---|---|
| Nickname | Novartis ID | DNA2.0 ID |
| BCMA-1 | ER95-03VA | 139100 |
| BCMA-2 | UR96-08PA | 139101 |
| BCMA-3 | KR98-03KA | 139102 |
| BCMA-4 | JF32-78IB | 139103 |
| BCMA-5 | AR99-08FA | 139104 |
| BCMA-6 | ZF34-73CB | 139105 |
| BCMA-7 | QR91-12ZA | 139106 |
| BCMA-8 | GR92-17UA | 139107 |
| BCMA-9 | OG62-93QB | 139108 |
| BCMA-10 | EG63-98LB | 139109 |
| BCMA-11 | UG65-93FB | 139110 |
| BCMA-12 | HU13-58ZB | 139111 |
| BCMA-13 | KG66-98AB | 139112 |
| BCMA-14 | HJ64-62PB | 139113 |
| BCMA-15 | PY43-48LB | 139114 |

TABLE 8

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/<br>Description | SEQ<br>ID<br>NO: | Sequence |
|---|---|---|
| | | 139109 |
| 139109- aa<br>ScFv domain | 49 | EVQLVESGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSSASGGGGSGGRASGGGGSDIQLTQSPSSLSASVGDRVTITCRASQ<br>SISSYLNWYQQKPGKAPKLLIYAASSLQSGVPSRFSGSGSGTDFTLTISSLQP<br>EDFATYYCQQSYSTPYTFGQGTKVEIK |
| 139109- nt<br>ScFv domain | 64 | GAAGTGCAATTGGTGGAATCAGGGGGAGGACTTGTGCAGCCTGGAGGATCGCT<br>GAGACTGTCATGTGCCGTGTCCGGCTTTGCCCTGTCCAACCACGGGATGTCCT<br>GGGTCCGCCGCGCGCCTGGAAAGGGCCTCGAATGGGTGTCGGGTATTGTGTAC<br>AGCGGTAGCACCTACTATGCCGCATCCGTGAAGGGGAGATTCACCATCAGCCG<br>GGACAACTCCAGGAACACTCTGTACCTCCAAATGAATTCGCTGAGGCCAGAGG<br>ACACTGCCATCTACTACTGCTCCGCGCATGGCGGAGAGTCCGACGTCTGGGGA<br>CAGGGGACCACCGTGACCGTGTCTAGCGCGTCCGGCGGAGGCGGCAGCGGGGG<br>TCGGGCATCAGGGGGCGGCGGATCGGACATCCAGCTCACCCAGTCCCCGAGCT<br>CGCTGTCCGCCTCCGTGGGAGATCGGGTCACCATCACGTGCCGCGCCAGCCAG<br>TCGATTTCCTCCTACCTGAACTGGTACCAACAGAAGCCCGGAAAAGCCCCGAA<br>GCTTCTCATCTACGCCGCCTCGAGCCTGCAGTCAGGAGTGCCCTCACGGTTCT<br>CCGGCTCCGGTTCCGGTACTGATTTCACCCTGACCATTTCCTCCCTGCAACCG<br>GAGGACTTCGCTACTTACTACTGCCAGCAGTCGTACTCCACCCCCTACACTTT<br>CGGACAAGGCACCAAGGTCGAAATCAAG |
| 139109- aa<br>VH | 79 | EVQLVESGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSS |
| 139109- aa<br>VL | 94 | DIQLTQSPSSLSASVGDRVTITCRASQSISSYLNWYQQKPGKAPKLLIYAASS<br>LQSGVPSRFSGSGSGTDFTLTISSLQPEDFATYYCQQSYSTPYTFGQGTKVEI<br>K |
| 139109- aa<br>Full CAR | 109 | MALPVTALLLPLALLLHAARPEVQLVESGGGLVQPGGSLRLSCAVSGFALSNH<br>GMSWVRRAPGKGLEWVSGIVYSGSTYYAASVKGRFTISRDNSRNTLYLQMNSL<br>RPEDTAIYYCSAHGGESDVWGQGTTVTVSSASGGGGSGGRASGGGGSDIQLTQ<br>SPSSLSASVGDRVTITCRASQSISSYLNWYQQKPGKAPKLLIYAASSLQSGVP<br>SRFSGSGSGTDFTLTISSLQPEDFATYYCQQSYSTPYTFGQGTKVEIKTTTPA<br>PRPPTPAPTIASQPLSLRPEACRPAAGGAVHTRGLDFACDIYIWAPLAGTCGV<br>LLLSLVITLYCKRGRKKLLYIFKQPFMRPVQTTQEEDGCSCRFPEEEEGGCEL<br>RVKFSRSADAPAYKQGQNQLYNELNLGRREEYDVLDKRRGRDPEMGGKPRRKN<br>PQEGLYNELQKDKMAEAYSEIGMKGERRRGKGHDGLYQGLSTATKDTYDALHM<br>QALPPR |
| 139109- nt<br>Full CAR | 124 | ATGGCCCTCCCTGTCACCGCCCTGCTGCTTCCGCTGGCTCTTCTGCTCCACGC<br>CGCTCGGCCCGAAGTGCAATTGGTGGAATCAGGGGGAGGACTTGTGCAGCCTG<br>GAGGATCGCTGAGACTGTCATGTGCCGTGTCCGGCTTTGCCCTGTCCAACCAC<br>GGGATGTCCTGGGTCCGCCGCGCGCCTGGAAAGGGCCTCGAATGGGTGTCGGG<br>TATTGTGTACAGCGGTAGCACCTACTATGCCGCATCCGTGAAGGGGAGATTCA<br>CCATCAGCCGGGACAACTCCAGGAACACTCTGTACCTCCAAATGAATTCGCTG<br>AGGCCAGAGGACACTGCCATCTACTACTGCTCCGCGCATGGCGGAGAGTCCGA<br>CGTCTGGGGACAGGGGACCACCGTGACCGTGTCTAGCGCGTCCGGCGGAGGCG<br>GCAGCGGGGGTCGGGCATCAGGGGGCGGCGGATCGGACATCCAGCTCACCCAG<br>TCCCCGAGCTCGCTGTCCGCCTCCGTGGGAGATCGGGTCACCATCACGTGCCG<br>CGCCAGCCAGTCGATTTCCTCCTACCTGAACTGGTACCAACAGAAGCCCGGAA<br>AAGCCCCGAAGCTTCTCATCTACGCCGCCTCGAGCCTGCAGTCAGGAGTGCCC<br>TCACGGTTCTCCGGCTCCGGTTCCGGTACTGATTTCACCCTGACCATTTCCTC<br>CCTGCAACCGGAGGACTTCGCTACTTACTACTGCCAGCAGTCGTACTCCACCC<br>CCTACACTTTCGGACAAGGCACCAAGGTCGAAATCAAGACCACTACCCCAGCA<br>CCGAGGCCACCCACCCCGGCTCCTACCATCGCCTCCCAGCCTCTGTCCCTGCG<br>TCCGGAGGCATGTAGACCCGCAGCTGGTGGGGCCGTGCATACCCGGGTCTTG<br>ACTTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAGCT<br>GCTGTACATCTTTAAGCAACCCTTCATGAGGCCTGTGCAGACTACTCAAGAGG<br>AGGACGGCTGTTCATGCCGGTTCCCAGAGGAGGAGGAAGGCGGCTGCGAACTG<br>CGCGTGAAATTCAGCCGCAGCGCAGATGCTCCAGCCTACAAGCAGGGGCAGAA<br>CCAGCTCTACAACGAACTCAATCTTGGTCGGAGAGAGGAGTACGACGTGCTGG<br>ACAAGCGGAGAGGACGGGACCCAGAAATGGGCGGGAAGCCGCGCAGAAAGAAT<br>CCCCAAGAGGGCCTGTACAACGAGCTCCAAAAGGATAAGATGGCAGAAGCCTA<br>TAGCGAGATTGGTATGAAAGGGGAACGCAGAAGAGGCAAAGGCCACGACGGAC<br>TGTACCAGGGACTCAGCACCGCCACCAAGGACACCTATGACGCTCTTCACATG<br>CAGGCCCTGCCGCCTCGG |
| | | 139103 |
| 139103- aa<br>ScFv domain | 39 | QVQLVESGGGLVQPGRSLRLSCAASGFTFSNYAMSWVRQAPGKGLGWVSGISR<br>SGENTYYADSVKGRFTISRDNSKNTLYLQMNSLRDEDTAVYYCARSPAHYYGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| 139103- nt ScFv domain | 54 | MDVWGQGTTVTVSSASGGGGSGGRASGGGGSDIVLTQSPGTLSLSPGERATLS<br>CRASQSISSSFLAWYQQKPGQAPRLLIYGASRRATGIPDRFSGSGSGTDFTLT<br>ISRLEPEDSAVYYCQQYHSSPSWTFGQGTKLEIK<br>CAAGTGCAACTCGTGGAATCTGGTGGAGGACTCGTGCAACCCGGAAGATCGCT<br>TAGACTGTCGTGTGCCGCCAGCGGGTTCACTTTCTCGAACTACGCGATGTCCT<br>GGGTCCGCCAGGCACCCGGAAAGGGACTCGGTTGGGTGTCCGGCATTTCCCGG<br>TCCGGCGAAAATACCTACTACGCCGACTCCGTGAAGGGCCGCTTCACCATCTC<br>AAGGGACAACAGCAAAAACACCCTGTACTTGCAAATGAACTCCCTGCGGGATG<br>AAGATACAGCCGTGTACTATTGCGCCCGGTCGCCTGCCCATTACTACGGCGGA<br>ATGGACGTCTGGGGACAGGGAACCACTGTGACTGTCAGCAGCGCGTCGGGTGG<br>CGGCGGCTCAGGGGGTCGGGCCTCCGGGGGGGAGGGTCCGACATCGTGCTGA<br>CCCAGTCCCCGGGAACCCTGAGCCTGAGCCCGGGAGAGCGCGCGACCCTGTCA<br>TGCCGGGCATCCCAGAGCATTAGCTCCTCCTTTCTCGCCTGGTATCAGCAGAA<br>GCCCGGACAGGCCCCGAGGCTGCTGATCTACGGCGCTAGCAGAAGGGCTACCG<br>GAATCCCAGACCGGTTCTCCGGCTCCGGTTCCGGGACCGATTTCACCCTTACT<br>ATCTCGCGCCTGGAACCTGAGGACTCCGCCGTCTACTACTGCCAGCAGTACCA<br>CTCATCCCCGTCGTGGACGTTCGGACAGGGCACCAAGCTGGAGATTAAG |
| 139103- aa VH | 69 | QVQLVESGGGLVQPGRSLRLSCAASGFTFSNYAMSWVRQAPGKGLGWVSGISR<br>SGENTYYADSVKGRFTISRDNSKNTLYLQMNSLRDEDTAVYYCARSPAHYYGG<br>MDVWGQGTTVTVSS |
| 139103- aa VL | 84 | DIVLTQSPGTLSLSPGERATLSCRASQSISSSFLAWYQQKPGQAPRLLIYGAS<br>RRATGIPDRFSGSGSGTDFTLTISRLEPEDSAVYYCQQYHSSPSWTFGQGTKL<br>EIK |
| 139103- aa Full CAR | 99 | MALPVTALLLPLALLLHAARPQVQLVESGGGLVQPGRSLRLSCAASGFTFSNY<br>AMSWVRQAPGKGLGWVSGISRSGENTYYADSVKGRFTISRDNSKNTLYLQMNS<br>LRDEDTAVYYCARSPAHYYGGMDVWGQGTTVTVSSASGGGGSGGRASGGGGSD<br>IVLTQSPGTLSLSPGERATLSCRASQSISSSFLAWYQQKPGQAPRLLIYGASR<br>RATGIPDRFSGSGSGTDFTLTISRLEPEDSAVYYCQQYHSSPSWTFGQGTKLE<br>IKTTTPAPRPPTPAPTIASQPLSLRPEACRPAAGGAVHTRGLDFACDIYIWAP<br>LAGTCGVLLLSLVITLYCKRGRKKLLYIFKQPFMRPVQTTQEEDGCSCRFPEE<br>EEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKD<br>TYDALHMQALPPR |
| 139103- nt Full CAR | 114 | ATGGCCCTCCCTGTCACCGCCCTGCTGCTTCCGCTGGCTCTTCTGCTCCACGC<br>CGCTCGGCCCCAAGTGCAACTCGTGGAATCTGGTGGAGGACTCGTGCAACCCG<br>GAAGATCGCTTAGACTGTCGTGTGCCGCCAGCGGGTTCACTTTCTCGAACTAC<br>GCGATGTCCTGGGTCCGCCAGGCACCCGGAAAGGGACTCGGTTGGGTGTCCGG<br>CATTTCCCGGTCCGGCGAAAATACCTACTACGCCGACTCCGTGAAGGGCCGCT<br>TCACCATCTCAAGGGACAACAGCAAAAACACCCTGTACTTGCAAATGAACTCC<br>CTGCGGGATGAAGATACAGCCGTGTACTATTGCGCCCGGTCGCCTGCCCATTA<br>CTACGGCGGAATGGACGTCTGGGGACAGGGAACCACTGTGACTGTCAGCAGCG<br>CGTCGGGTGGCGGCGGCTCAGGGGGTCGGGCCTCCGGGGGGGAGGGTCCGAC<br>ATCGTGCTGACCCAGTCCCCGGGAACCCTGAGCCTGAGCCCGGGAGAGCGCGC<br>GACCCTGTCATGCCGGGCATCCCAGAGCATTAGCTCCTCCTTTCTCGCCTGGT<br>ATCAGCAGAAGCCCGGACAGGCCCCGAGGCTGCTGATCTACGGCGCTAGCAGA<br>AGGGCTACCGGAATCCCAGACCGGTTCTCCGGCTCCGGTTCCGGGACCGATTT<br>CACCCTTACTATCTCGCGCCTGGAACCTGAGGACTCCGCCGTCTACTACTGCC<br>AGCAGTACCACTCATCCCCGTCGTGGACGTTCGGACAGGGCACCAAGCTGGAG<br>ATTAAGACCACTACCCCAGCACCGAGGCCACCCACCCCGGCTCCTACCATCGC<br>CTCCCAGCCTCTGTCCCTGCGTCCGGAGGCATGTAGACCCGCAGCTGGTGGGG<br>CCGTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTACTG<br>TAAGCGCGGTCGGAAGAAGCTGCTGTACATCTTTAAGCAACCCTTCATGAGGC<br>CTGTGCAGACTACTCAAGAGGAGGACGGCTGTTCATGCCGGTTCCCAGAGGAG<br>GAGGAAGGCGGCTGCGAACTGCGCGTGAAATTCAGCCGCAGCGCAGATGCTCC<br>AGCCTACAAGCAGGGGCAGAACCAGCTCTACAACGAACTCAATCTTGGTCGGA<br>GAGAGGAGTACGACGTGCTGGACAAGCGGAGAGGACGGGACCCAGAAATGGGC<br>GGGAAGCCGCGCAGAAAGAATCCCCAAGAGGGCCTGTACAACGAGCTCCAAAA<br>GGATAAGATGGCAGAAGCCTATAGCGAGATTGGTATGAAAGGGGAACGCAGAA<br>GAGGCAAAGGCCACGACGGACTGTACCAGGGACTCAGCACCGCCACCAAGGAC<br>ACCTATGACGCTCTTCACATGCAGGCCCTGCCGCCTCGG |

139105

| 139105- aa ScFv domain | 40 | QVQLVESGGGLVQPGRSLRLSCAASGFTFDDYAMHWVRQAPGKGLEWVSGISW<br>NSGSIGYADSVKGRFTISRDNAKNSLYLQMNSLRAEDTALYYCSVHSFLAYWG<br>QGTLVTVSSASGGGGSGGRASGGGGSDIVMTQTPLSLPVTPGEPASISCRSSQ<br>SLLHSNGYNYLDWYLQKPGQSPQLLIYLGSNRASGVPDRFSGSGSGTDFTLKI<br>SRVEAEDVGVYYCMQALQTPYTFGQGTKVEIK |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| 139105- nt<br>ScFv domain | 55 | CAAGTGCAACTCGTCGAATCCGGTGGAGGTCTGGTCCAACCTGGTAGAAGCCT<br>GAGACTGTCGTGTGCGGCCAGCGGATTCACCTTTGATGACTATGCTATGCACT<br>GGGTGCGGCAGGCCCCAGGAAAGGGCCTGGAATGGGTGTCGGGAATTAGCTGG<br>AACTCCGGGTCCATTGGCTACGCCGACTCCGTGAAGGGCCGCTTCACCATCTC<br>CCGCGACAACGCAAAGAACTCCCTGTACTTGCAAATGAACTCGCTCAGGGCTG<br>AGGATACCGCGCTGTACTACTGCTCCGTGCATTCCTTCCTGGCCTACTGGGGA<br>CAGGGAACTCTGGTCACCGTGTCGAGCGCCTCCGGCGGCGGGGGCTCGGGTGG<br>ACGGGCCTCGGGCGGAGGGGGGTCCGACATCGTGATGACCCAGACCCCGCTGA<br>GCTTGCCCGTGACTCCCGGAGAGCCTGCATCCATCTCCTGCCGGTCATCCCAG<br>TCCCTTCTCCACTCCAACGGATACAACTACCTCGACTGGTACCTCCAGAAGCC<br>GGGACAGAGCCCTCAGCTTCTGATCTACCTGGGGTCAAATAGAGCCTCAGGAG<br>TGCCGGATCGGTTCAGCGGATCTGGTTCGGGAACTGATTTCACTCTGAAGATT<br>TCCCGCGTGGAAGCCGAGGACGTGGGCGTCTACTACTGTATGCAGGCGCTGCA<br>GACCCCCTATACCTTCGGCCAAGGGACGAAAGTGGAGATCAAG |
| 139105- aa<br>VH | 70 | QVQLVESGGGLVQPGRSLRLSCAASGFTFDDYAMHWVRQAPGKGLEWVSGISW<br>NSGSIGYADSVKGRFTISRDNAKNSLYLQMNSLRAEDTALYYCSVHSFLAYWG<br>QGTLVTVSS |
| 139105- aa<br>VL | 85 | DIVMTQTPLSLPVTPGEPASISCRSSQSLLHSNGYNYLDWYLQKPGQSPQLLI<br>YLGSNRASGVPDRFSGSGSGTDFTLKISRVEAEDVGVYYCMQALQTPYTFGQG<br>TKVEIK |
| 139105- aa<br>Full CAR | 100 | MALPVTALLLPLALLLHAARPQVQLVESGGGLVQPGRSLRLSCAASGFTFDDY<br>AMHWVRQAPGKGLEWVSGISWNSGSIGYADSVKGRFTISRDNAKNSLYLQMNS<br>LRAEDTALYYCSVHSFLAYWGQGTLVTVSSASGGGGSGGRASGGGGSDIVMTQ<br>TPLSLPVTPGEPASISCRSSQSLLHSNGYNYLDWYLQKPGQSPQLLIYLGSNR<br>ASGVPDRFSGSGSGTDFTLKISRVEAEDVGVYYCMQALQTPYTFGQGTKVEIK<br>TTTPAPRPPTPAPTIASQPLSLRPEACRPAAGGAVHTRGLDFACDIYIWAPLA<br>GTCGVLLLSLVITLYCKRGRKKLLYIFKQPFMRPVQTTQEEDGCSCRFPEEEE<br>GGCELRVKFSRSADAPAYKQGQNQLYNELNLGRREEYDVLDKRRGRDPEMGGK<br>PRRKNPQEGLYNELQKDKMAEAYSEIGMKGERRRGKGHDGLYQGLSTATKDTY<br>DALHMQALPPR |
| 139105- nt<br>Full CAR | 115 | ATGGCCCTCCCTGTCACCGCCCTGCTGCTTCCGCTGGCTCTTCTGCTCCACGC<br>CGCTCGGCCCCAAGTGCAACTCGTCGAATCCGGTGGAGGTCTGGTCCAACCTG<br>GTAGAAGCCTGAGACTGTCGTGTGCGGCCAGCGGATTCACCTTTGATGACTAT<br>GCTATGCACTGGGTGCGGCAGGCCCCAGGAAAGGGCCTGGAATGGGTGTCGGG<br>AATTAGCTGGAACTCCGGGTCCATTGGCTACGCCGACTCCGTGAAGGGCCGCT<br>TCACCATCTCCCGCGACAACGCAAAGAACTCCCTGTACTTGCAAATGAACTCG<br>CTCAGGGCTGAGGATACCGCGCTGTACTACTGCTCCGTGCATTCCTTCCTGGC<br>CTACTGGGGACAGGGAACTCTGGTCACCGTGTCGAGCGCCTCCGGCGGCGGGG<br>GCTCGGGTGGACGGGCCTCGGGCGGAGGGGGGTCCGACATCGTGATGACCCAG<br>ACCCCGCTGAGCTTGCCCGTGACTCCCGGAGAGCCTGCATCCATCTCCTGCCG<br>GTCATCCCAGTCCCTTCTCCACTCCAACGGATACAACTACCTCGACTGGTACC<br>TCCAGAAGCCGGGACAGAGCCCTCAGCTTCTGATCTACCTGGGGTCAAATAGA<br>GCCTCAGGAGTGCCGGATCGGTTCAGCGGATCTGGTTCGGGAACTGATTTCAC<br>TCTGAAGATTTCCCGCGTGGAAGCCGAGGACGTGGGCGTCTACTACTGTATGC<br>AGGCGCTGCAGACCCCCTATACCTTCGGCCAAGGGACGAAAGTGGAGATCAAG<br>ACCACTACCCCAGCACCGAGGCCACCCACCCCGGCTCCTACCATCGCCTCCCA<br>GCCTCTGTCCCTGCGTCCGAGGCATGTAGACCCGCAGCTGGTGGGGCCGTGC<br>ATACCCGGGGTCTTGACTTCGCCTGCGATATCTACATTTGGGCCCCTCTGGCT<br>GGTACTTGCGGGGTCCTGCTGCTTTCACTCGTGATCACTCTTTACTGTAAGCG<br>CGGTCGGAAGAAGCTGCTGTACATCTTTAAGCAACCCTTCATGAGGCCTGTGC<br>AGACTACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCAGCCTA<br>CAAGCAGGGGCAGAACCAGCTCTACAACGAACTCAATCTTGGTCGGAGAGAGG<br>AGTACGACGTGCTGGACAAGCGGAGAGGACGGGACCCAGAAATGGGCGGGAAG<br>CCGCGCAGAAAGAATCCCCAAGAGGGCCTGTACAACGAGCTCCAAAAGGATAA<br>GATGGCAGAAGCCTATAGCGAGATTGGTATGAAAGGGGAACGCAGAAGAGGCA<br>AAGGCCACGACGGACTGTACCAGGGACTCAGCACCGCCACCAAGGACACCTAT<br>GACGCTCTTCACATGCAGGCCCTGCCGCCTCGG |
| 139111 | | |
| 139111- aa<br>ScFv domain | 41 | EVQLLESGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGESDVWG<br>QGTTVTVSSASGGGGSGGRASGGGGSDIVMTQTPLSLSVTPGQPASISCKSSQ<br>SLLRNDGKTPLYWYLQKAGQPPQLLIYEVSNRFSGVPDRFSGSGSGTDFTLKI<br>SRVEAEDVGAYYCMQNIQFPSFGGGTKLEIK |
| 139111- nt<br>ScFv domain | 56 | GAAGTGCAATTGTTGGAATCTGGAGGAGGACTTGTGCAGCCTGGAGGATCACT<br>GAGACTTTCGTGTGCGGTGTCAGGCTTCGCCCTGAGCAACCACGGCATGAGCT<br>GGGTGCGGAGAGCCCCGGGGAAGGGTCTGGAATGGGTGTCCGGGATCGTCTAC<br>TCCGGTTCAACTTACTACGCCGCAAGCGTGAAGGGTCGCTTCACCATTTCCCG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | CGATAACTCCCGGAACACCCTGTACCTCCAAATGAACTCCCTGCGGCCCGAGG<br>ACACCGCCATCTACTACTGTTCCGCGCATGGAGGAGAGTCCGATGTCTGGGGA<br>CAGGGCACTACCGTGACCGTGTCGAGCGCCTCGGGGGGAGGAGGCTCCGGCGG<br>TCGCGCCTCCGGGGGGGGTGGCAGCGACATTGTGATGACGCAGACTCCACTCT<br>CGCTGTCCGTGACCCCGGGACAGCCCGCGTCCATCTCGTGCAAGAGCTCCCAG<br>AGCCTGCTGAGGAACGACGGAAAGACTCCTCTGTATTGGTACCTCCAGAAGGC<br>TGGACAGCCCCCGCAACTGCTCATCTACGAAGTGTCAAATCGCTTCTCCGGGG<br>TGCCGGATCGGTTTTCCGGCTCGGGATCGGGCACCGACTTCACCCTGAAAATC<br>TCCAGGGTCGAGGCCGAGGACGTGGGAGCCTACTACTGCATGCAAAACATCCA<br>GTTCCCTTCCTTCGGCGGCGGCACAAAGCTGGAGATTAAG |
| 139111- aa<br>VH | 71 | EVQLLESGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSS |
| 139111- aa<br>VL | 86 | DIVMTQTPLSLSVTPGQPASISCKSSQSLLRNDGKTPLYWYLQKAGQPPQLLI<br>YEVSNRFSGVPDRFSGSGSGTDFTLKISRVEAEDVGAYYCMQNIQFPSFGGGT<br>KLEIK |
| 139111- aa<br>Full CAR | 101 | MALPVTALLLPLALLLHAARPEVQLLESGGGLVQPGGSLRLSCAVSGFALSNH<br>GMSWVRRAPGKGLEWVSGIVYSGSTYYAASVKGRFTISRDNSRNTLYLQMNSL<br>RPEDTAIYYCSAHGGESDVWGQGTTVTVSSASGGGGSGGRASGGGGSDIVMTQ<br>TPLSLSVTPGQPASISCKSSQSLLRNDGKTPLYWYLQKAGQPPQLLIYEVSNR<br>FSGVPDRFSGSGSGTDFTLKISRVEAEDVGAYYCMQNIQFPSFGGGTKLEIKT<br>TTPAPRPPTPAPTIASQPLSLRPEACRPAAGGAVHTRGLDFACDIYIWAPLAG<br>TCGVLLLSLVITLYCKRGRKKLLYIFKQPFMRPVQTTQEEDGCSCRFPEEEEG<br>GCELRVKFSRSADAPAYKQGQNQLYNELNLGRREEYDVLDKRRGRDPEMGGKP<br>RRKNPQEGLYNELQKDKMAEAYSEIGMKGERRRGKGHDGLYQGLSTATKDTYD<br>ALHMQALPPR |
| 139111- nt<br>Full CAR | 116 | ATGGCCCTCCCTGTCACCGCCCTGCTGCTTCCGCTGGCTCTTCTGCTCCACGC<br>CGCTCGGCCCGAAGTGCAATTGTTGGAATCTGGAGGAGGACTTGTGCAGCCTG<br>GAGGATCACTGAGACTTTCGTGTGCGGTGTCAGGCTTCGCCCTGAGCAACCAC<br>GGCATGAGCTGGGTGCGGAGAGCCCCGGGGAAGGGTCTGGAATGGGTGTCCGG<br>GATCGTCTACTCCGGTTCAACTTACTACGCCGCAAGCGTGAAGGGTCGCTTCA<br>CCATTTCCCGCGATAACTCCCGGAACACCCTGTACCTCCAAATGAACTCCCTG<br>CGGCCCGAGGACACCGCCATCTACTACTGTTCCGCGCATGGAGGAGAGTCCGA<br>TGTCTGGGGACAGGGCACTACCGTGACCGTGTCGAGCGCCTCGGGGGGAGGAG<br>GCTCCGGCGGTCGCGCCTCCGGGGGGGTGGCAGCGACATTGTGATGACGCAG<br>ACTCCACTCTCGCTGTCCGTGACCCCGGGACAGCCCGCGTCCATCTCGTGCAA<br>GAGCTCCCAGAGCCTGCTGAGGAACGACGGAAAGACTCCTCTGTATTGGTACC<br>TCCAGAAGGCTGGACAGCCCCCGCAACTGCTCATCTACGAAGTGTCAAATCGC<br>TTCTCCGGGGTGCCGGATCGGTTTTCCGGCTCGGGATCGGGCACCGACTTCAC<br>CCTGAAAATCTCCAGGGTCGAGGCCGAGGACGTGGGAGCCTACTACTGCATGC<br>AAAACATCCAGTTCCCTTCCTTCGGCGGCGGCACAAAGCTGGAGATTAAGACC<br>ACTACCCCAGCACCGAGGCACCCACCCCGGCTCCTACCATCGCCTCCCAGCC<br>TCTGTCCCTGCGTCCGGAGGCATGTAGACCCGCAGCTGGTGGGGCCGTGCATA<br>CCCGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGCGG<br>TCGGAAGAAGCTGCTGTACATCTTTAAGCAACCCTTCATGAGGCCTGTGCAGA<br>CTACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTACAA<br>GCAGGGGCAGAACCAGCTCTACAACGAACTCAATCTTGGTCGGAGAGAGGAGT<br>ACGACGTGCTGGACAAGCGGAGGACGGGACCCAGAAATGGGCGGGAAGCCG<br>CGCAGAAAGAATCCCCAAGAGGGCCTGTACAACGAGCTCCAAAAGGATAAGAT<br>GGCAGAAGCCTATAGCGAGATTGGTATGAAAGGGAACGCAGAAGAGGCAAAG<br>GCCACGACGGACTGTACCAGGGACTCAGCACCGCCACCAAGGACACCTATGAC<br>GCTCTTCACATGCAGGCCCTGCCGCCTCGG |

139100

| 139100- aa<br>ScFv domain | 42 | QVQLVQSGAEVRKTGASVKVSCKASGYIFDNFGINWVRQAPGQGLEWMGWINP<br>KNNNTNYAQKFQGRVTITADESTNTAYMEVSSLRSEDTAVYYCARGPYYYQSY<br>MDVWGQGTMVTVSSASGGGGSGGRASGGGGSDIVMTQTPLSLPVTPGEPASIS<br>CRSSQSLLHSNGYNYLNWYLQKPGQSPQLLIYLGSKRASGVPDRFSGSGSGTD<br>FTLHITRVGAEDVGVYYCMQALQTPYTFGQGTKLEIK |
| 139100- nt<br>ScFv domain | 57 | CAAGTCCAACTCGTCCAGTCCGGCGCAGAAGTCAGAAAAACCGGTGCTAGCGT<br>GAAAGTGTCCTGCAAGGCCTCCGGCTACATTTTCGATAACTTCGGAATCAACT<br>GGGTCAGACAGGCCCCGGGCCAGGGGCTGGAATGGATGGGATGGATCAACCCC<br>AAGAACAACAACACCAACTACGCACAGAAGTTCCAGGGCCGCGTGACTATCAC<br>CGCCGATGAATCGACCAATACCGCCTACATGGAGGTGTCCTCCCTGCGGTCGG<br>AGGACACTGCCGTGTATTACTGCGCGAGGGGCCCATACTACTACCAAAGCTAC<br>ATGGACGTCTGGGGACAGGGAACCATGGTGACCGTGTCATCCGCCTCCGGTGG<br>TGGAGGCTCCGGGGGCGGGCTTCAGGAGGCGGAGGAAGCGATATTGTGATGA |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | CCCAGACTCCGCTTAGCCTGCCCGTGACTCCTGGAGAACCGGCCTCCATTTCC<br>TGCCGGTCCTCGCAATCACTCCTGCATTCCAACGGTTACAACTACCTGAATTG<br>GTACCTCCAGAAGCCTGGCCAGTCGCCCCAGTTGCTGATCTATCTGGGCTCGA<br>AGCGCGCCTCCGGGGTGCCTGACCGGTTTAGCGGATCTGGGAGCGGCACGGAC<br>TTCACTCTCCACATCACCCGCGTGGGAGCGGAGGACGTGGGAGTGTACTACTG<br>TATGCAGGCGCTGCAGACTCCGTACACATTCGGACAGGGCACCAAGCTGGAGA<br>TCAAG |
| 139100-<br>VH aa | 72 | QVQLVQSGAEVRKTGASVKVSCKASGYIFDNFGINWVRQAPGQGLEWMGWINP<br>KNNNTNYAQKFQGRVTITADESTNTAYMEVSSLRSEDTAVYYCARGPYYYQSY<br>MDVWGQGTMVTVSS |
| 139100-<br>VL aa | 87 | DIVMTQTPLSLPVTPGEPASISCRSSQSLLHSNGYNYLNWYLQKPGQSPQLLI<br>YLGSKRASGVPDRFSGSGSGTDFTLHITRVGAEDVGVYYCMQALQTPYTFGQG<br>TKLEIK |
| 139100-<br>Full CAR aa | 102 | MALPVTALLLPLALLLHAARPQVQLVQSGAEVRKTGASVKVSCKASGYIFDNF<br>GINWVRQAPGQGLEWMGWINPKNNNTNYAQKFQGRVTITADESTNTAYMEVSS<br>LRSEDTAVYYCARGPYYYQSYMDVWGQGTMVTVSSASGGGGSGGRASGGGGSD<br>IVMTQTPLSLPVTPGEPASISCRSSQSLLHSNGYNYLNWYLQKPGQSPQLLIY<br>LGSKRASGVPDRFSGSGSGTDFTLHITRVGAEDVGVYYCMQALQTPYTFGQGT<br>KLEIKTTTPAPRPPTPAPTIASQPLSLRPEACRPAAGGAVHTRGLDFACDIYI<br>WAPLAGTCGVLLLSLVITLYCKRGRKKLLYIFKQPFMRPVQTTQEEDGCSCRF<br>PEEEEGGCELRVKFSRSADAPAYKQGQNQLYNELNLGRREEYDVLDKRRGRDP<br>EMGGKPRRKNPQEGLYNELQKDKMAEAYSEIGMKGERRRGKGHDGLYQGLSTA<br>TKDTYDALHMQALPPR |
| 139100-<br>Full CAR nt | 117 | ATGGCCCTCCCTGTCACCGCCCTGCTGCTTCCGCTGGCTCTTCTGCTCCACGC<br>CGCTCGGCCCCAAGTCCAACTCGTCCAGTCCGGCGCAGAAGTCAGAAAAACCG<br>GTGCTAGCGTGAAAGTGTCCTGCAAGGCCTCCGGCTACATTTTCGATAACTTC<br>GGAATCAACTGGGTCAGACAGGCCCCCGGGCCAGGGGCTGGAATGGATGGGATG<br>GATCAACCCCAAGAACAACAACACCAACTACGCACAGAAGTTCCAGGGCCGCG<br>TGACTATCACCGCCGATGAATCGACCAATACCGCCTACATGGAGGTGTCCTCC<br>CTGCGGTCGGAGGACACTGCCGTGTATTACTGCGCGAGGGGCCCATACTACTA<br>CCAAAGCTACATGGACGTCTGGGGACAGGGAACCATGGTGACCGTGTCATCCG<br>CCTCCGGTGGTGGAGGCTCCGGGGGCGGGCTTCAGGAGGCGGAGGAAGCGAT<br>ATTGTGATGACCCAGACTCCGCTTAGCCTGCCCGTGACTCCTGGAGAACCGGC<br>CTCCATTTCCTGCCGGTCCTCGCAATCACTCCTGCATTCAACGGTTACAACT<br>ACCTGAATTGGTACCTCCAGAAGCCTGGCCAGTCGCCCCAGTTGCTGATCTAT<br>CTGGGCTCGAAGCGCGCCTCCGGGGTGCCTGACCGGTTTAGCGGATCTGGGAG<br>CGGCACGGACTTCACTCTCCACATCACCCGCGTGGGAGCGGAGGACGTGGGAG<br>TGTACTACTGTATGCAGGCGCTGCAGACTCCGTACACATTCGGACAGGGCACC<br>AAGCTGGAGATCAAGACCACTACCCCAGCACCGAGGCCACCCACCCCGGCTCC<br>TACCATCGCCTCCCAGCCTCTGTCCCTGCGTCCGGAGGCATGTAGACCCGCAG<br>CTGGTGGGGCCGTGCATACCCGGGGTCTTGACTTCGCCTGCGATATCTACATT<br>TGGGCCCCTCTGGCTGGTACTTGCGGGGTCCTGCTGCTTTCACTCGTGATCAC<br>TCTTTACTGTAAGCGCGGTCGGAAGAAGCTGCTGTACATCTTTAAGCAACCCT<br>TCATGAGGCCTGTGCAGACTACTCAAGAGGAGGACGGCTGTTCATGCCGGTTC<br>CCAGAGGAGGAGGAAGGCGGCTGCGAACTGCGCGTGAAATTCAGCCGCAGCGC<br>AGATGCTCCAGCCTACAAGCAGGGGCAGAACCAGCTCTACAACGAACTCAATC<br>TTGGTCGGAGAGAGGAGTACGACGTGCTGGACAAGCGGAGAGGACGGGACCCA<br>GAAATGGGCGGGAAGCCGCGCAGAAAGAATCCCCAAGAGGGCCTGTACAACGA<br>GCTCCAAAAGGATAAGATGGCAGAAGCCTATAGCGAGATTGGTATGAAAGGGG<br>AACGCAGAAGAGGCAAAGGCCACGACGGACTGTACCAGGGACTCAGCACCGCC<br>ACCAAGGACACCTATGACGCTCTTCACATGCAGGCCCTGCCGCCTCGG |

139101

| 139101- aa<br>ScFv domain | 43 | QVQLQESGGGLVQPGGSLRLSCAASGFTFSSDAMTWVRQAPGKGLEWVSVISG<br>SGGTTYYADSVKGRFTISRDNSKNTLYLQMNSLRAEDTAVYYCAKLDSSGYYY<br>ARGPRYWGQGTLVTVSSASGGGGSGGRASGGGGSDIQLTQSPSSLSASVGDRV<br>TITCRASQSISSYLNWYQQKPGKAPKLLIYGASTLASGVPARFSGSGSGTHFT<br>LTINSLQSEDSATYYCQQSYKRASFGQGTKVEIK |
| 139101- nt<br>ScFv domain | 58 | CAAGTGCAACTTCAAGAATCAGGCGGAGGACTCGTGCAGCCCGGAGGATCATT<br>GCGGCTCTCGTGCGCCGCCTCGGGCTTCACCTTCTCGAGCGACGCCATGACCT<br>GGGTCCGCCAGGCCCCGGGAAGGGGCTGGAATGGGTGTCTGTGATTTCCGGC<br>TCCGGGGGAACTACGTACTACGCCGATTCCGTGAAAGGTCGCTTCACTATCTC<br>CCGGGACAACAGCAAGAACACCCTTTATCTGCAAATGAATTCCCTCCGCGCCG<br>AGGACACCGCCGTGTACTACTGCGCCAAGCTGGACTCCTCGGGCTACTACTAT<br>GCCCGGGGTCCGAGATACTGGGGACAGGGAACCCTCGTGACCGTGTCCTCCGC<br>GTCCGGCGGAGGAGGTCGGGAGGCGGGCCTCCGGCGGCGGCGGTTCGGACA<br>TCCAGCTGACCCAGTCCCCATCCTCACTGAGCGCAAGCGTGGGCGACAGAGTC<br>ACCATTACATGCAGGGCGTCCCAGAGCATCAGCTCCTACCTGAACTGGTACCA<br>ACAGAAGCCTGGAAAGGCTCCTAAGCTGTTGATCTACGGGGCTTCGACCCTGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| | | CATCCGGGGTGCCCGCGAGGTTTAGCGGAAGCGGTAGCGGCACTCACTTCACT CTGACCATTAACAGCCTCCAGTCCGAGGATTCAGCCACTTACTACTGTCAGCA GTCCTACAAGCGGGCCAGCTTCGGACAGGGCACTAAGGTCGAGATCAAG |
| 139101- aa VH | 73 | QVQLQESGGGLVQPGGSLRLSCAASGFTFSSDAMTWVRQAPGKGLEWVSVISG SGGTTYYADSVKGRFTISRDNSKNTLYLQMNSLRAEDTAVYYCAKLDSSGYYY ARGPRYWGQGTLVTVSS |
| 139101- aa VL | 88 | DIQLTQSPSSLSASVGDRVTITCRASQSISSYLNWYQQKPGKAPKLLIYGAST LASGVPARFSGSGSGTHFTLTINSLQSEDSATYYCQQSYKRASFGQGTKVEIK |
| 139101- aa Full CAR | 103 | MALPVTALLLPLALLLHAARPQVQLQESGGGLVQPGGSLRLSCAASGFTFSSD AMTWVRQAPGKGLEWVSVISGSGGTTYYADSVKGRFTISRDNSKNTLYLQMNS LRAEDTAVYYCAKLDSSGYYYARGPRYWGQGTLVTVSSASGGGGSGGRASGGG GSDIQLTQSPSSLSASVGDRVTITCRASQSISSYLNWYQQKPGKAPKLLIYGA STLASGVPARFSGSGSGTHFTLTINSLQSEDSATYYCQQSYKRASFGQGTKVE IKTTTPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCRFPEE EEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKD TYDALHMQALPPR |
| 139101- nt Full CAR | 118 | ATGGCCCTCCCTGTCACCGCCCTGCTGCTTCCGCTGGCTCTTCTGCTCCACGC CGCTCGGCCCCAAGTCAACTTCAAGAATCAGGCGGAGGACTCGTGCAGCCCG GAGGATCATTGCGGCTCTCGTGCGCCGCCTCGGGCTTCACCTTCTCGAGCGAC GCCATGACCTGGGTCCGCCAGGCCCCGGGGAAGGGGCTGGAATGGGTGTCTGT GATTTCCGGCTCCGGGGGAACTACGTACTACGCCGATTCCGTGAAAGGTCGCT TCACTATCTCCCGGGACAACAGCAAGAACACCCTTTATCTGCAAATGAATTCC CTCCGCGCCGAGGACACCGCCGTGTACTACTGCGCCAAGCTGGACTCCTCGGG CTACTACTATGCCCGGGGTCCGAGATACTGGGGACAGGGAACCCTCGTGACCG TGTCCTCCGCGTCCGGCGGAGGAGGGTCGGGAGGGCGGGCCTCCGGCGGCGGC GGTTCGGACATCCAGCTGACCCAGTCCCCATCCTCACTGAGCGCAAGCGTGGG CGACAGAGTCACCATTACATGCAGGGCGTCCCAGAGCATCAGCTCCTACCTGA ACTGGTACCAACAGAAGCCTGGAAAGGCTCCTAAGCTGTTGATCTACGGGGCT TCGACCCTGGCATCCGGGTGCCCGCGAGGTTTAGCGGAAGCGGTAGCGGCAC TCACTTCACTCTGACCATTAACAGCCTCCAGTCCGAGGATTCAGCCACTTACT ACTGTCAGCAGTCCTACAAGCGGGCCAGCTTCGGACAGGGCACTAAGGTCGAG ATCAAGACCACTACCCCAGCACCGAGGCCACCCACCCCGGCTCCTACCATCGC CTCCCAGCCTCTGTCCCTGCGTCCGGAGGCATGTAGACCCGCAGCTGGTGGGG CCGTGCATACCCGGGGTCTTGACTTCGCCTGCGATATCTACATTTGGGCCCCT CTGGCTGGTACTTGCGGGGTCCTGCTGCTTTCACTCGTGATCACTCTTTACTG TAAGCGCGGTCGGAAGAAGCTGCTGTACATCTTTAAGCAACCCTTCATGAGGC CTGTGCAGACTACTCAAGAGGAGGACGGCTGTTCATGCCGGTTCCCAGAGGAG GAGGAAGGCGGCTGCGAACTGCGCGTGAAATTCAGCCGCAGCGCAGATGCTCC AGCCTACAAGCAGGGGCAGAACCAGCTCTACAACGAACTCAATCTTGGTCGGA GAGAGGAGTACGACGTGCTGGACAAGCGGAGAGGACGGGACCCAGAAATGGGC GGGAAGCCGCGCAGAAAGAATCCCCAAGAGGGCCTGTACAACGAGCTCCAAAA GGATAAGATGGCAGAAGCCTATAGCGAGATTGGTATGAAAGGGGAACGCAGAA GAGGCAAAGGCCACGACGGACTGTACCAGGGACTCAGCACCGCCACCAAGGAC ACCTATGACGCTCTTCACATGCAGGCCCTGCCGCCTCGG |

139102

| 139102- aa ScFv domain | 44 | QVQLVQSGAEVKKPGASVKVSCKASGYTFSNYGITWVRQAPGQGLEWMGWISA YNGNTNYAQKFQGRVTMTRNTSISTAYMELSSLRSEDTAVYYCARGPYYYYMD VWGKGTMVTVSSASGGGGSGGRASGGGGSEIVMTQSPLSLPVTPGEPASISCR SSQSLLYSNGYNYVDWYLQKPGQSPQLLIYLGSNRASGVPDRFSGSGSGTDFK LQISRVEAEDVGIYYCMQGRQFPYSFGQGTKVEIK |
| 139102- nt ScFv domain | 59 | CAAGTCCAACTGGTCCAGAGCGGTGCAGAAGTGAAGAAGCCCGGAGCGAGCGT GAAAGTGTCCTGCAAGGCTTCCGGGTACACCTTCTCCAACTACGGCATCACTT GGGTGCGCCAGGCCCCGGGACAGGGCCTGGAATGGATGGGGTGGATTTCCGCG TACAACGGCAATACGAACTACGCTCAGAAGTTCCAGGGTAGAGTGACCATGAC TAGGAACACCTCCATTTCCACCGCCTACATGGAACTGTCCTCCCTGCGGAGCG AGGACACCGCCGTGTACTATTGCGCCCGGGGACCATACTACTACTACATGGAT GTCTGGGGGAAGGGGACTATGGTCACCGTGTCATCCGCCTCGGGAGGCGGCGG ATCAGGAGGACGCGCCTCTGGTGGTGGAGGATCGGAGATCGTGATGACCCAGA GCCCTCTCTCCTTGCCCGTGACTCCTGGGGAGCCCGCATCCATTTCATGCCGG AGCTCCCAGTCACTTCTCTACTCCAACGGCTATAACTACGTGGATTGGTACCT CCAAAAGCCGGGCCAGAGCCCGCAGCTGCTGATCTACCTGGGCTCGAACAGGG CCAGCGGAGTGCCTGACCGGTTCTCCGGGTCGGGAAGCGGGACCGACTTCAAG CTGCAAATCTCGAGAGTGGAGGCCGAGGACGTGGGAATCTACTACTGTATGCA GGGCCGCCAGTTTCCGTACTCGTTCGGACAGGGCACCAAAGTGGAAATCAAG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| 139102- aa VH | 74 | QVQLVQSGAEVKKPGASVKVSCKASGYTFSNYGITWVRQAPGQGLEWMGWISA YNGNTNYAQKFQGRVTMTRNTSISTAYMELSSLRSEDTAVYYCARGPYYYYMD VWGKGTMVTVSS |
| 139102- aa VL | 89 | EIVMTQSPLSLPVTPGEPASISCRSSQSLLYSNGYNYVDWYLQKPGQSPQLLI YLGSNRASGVPDRFSGSGSGTDFKLQISRVEAEDVGIYYCMQGRQFPYSFGQG TKVEIK |
| 139102- aa Full CAR | 104 | MALPVTALLLPLALLLHAARPQVQLVQSGAEVKKPGASVKVSCKASGYTFSNY GITWVRQAPGQGLEWMGWISAYNGNTNYAQKFQGRVTMTRNTSISTAYMELSS LRSEDTAVYYCARGPYYYYMDVWGKGTMVTVSSASGGGGSGGRASGGGGSEIV MTQSPLSLPVTPGEPASISCRSSQSLLYSNGYNYVDWYLQKPGQSPQLLIYLG SNRASGVPDRFSGSGSGTDFKLQISRVEAEDVGIYYCMQGRQFPYSFGQGTKV EIKTTTPAPRPPTPAPTIASQPLSLRPEACRPAAGGAVHTRGLDFACDIYIWA PLAGTCGVLLLSLVITLYCKRGRKKLLYIFKQPFMRPVQTTQEEDGCSCRFPE EEEGGCELRVKFSRSADAPAYKQGQNQLYNELNLGRREEYDVLDKRRGRDPEM GGKPRRKNPQEGLYNELQKDKMAEAYSEIGMKGERRRGKGHDGLYQGLSTATK DTYDALHMQALPPR |
| 139102- nt Full CAR | 119 | ATGGCCCTCCCTGTCACCGCCCTGCTGCTTCCGCTGGCTCTTCTGCTCCACGC CGCTCGGCCCCAAGTCCAACTGGTCCAGAGCGGTGCAGAAGTGAAGAAGCCCG GAGCGAGCGTGAAAGTGTCCTGCAAGGCTTCGGGTACACCTTCTCCAACTAC GGCATCACTTGGGTGCGCCAGGCCCCGGGACAGGGCCTGGAATGGATGGGGTG GATTTCCGCGTACAACGGCAATACGAACTACGCTCAGAAGTTCCAGGGTAGAG TGACCATGACTAGGAACACCTCCATTTCCACCGCCTACATGGAACTGTCCTCC CTGCGGAGCGAGGACACCGCCGTGTACTATTGCGCCCGGGGACCATACTACTA CTACATGGATGTCTGGGGAAGGGGACTATGGTCACCGTGTCATCCGCCTCGG GAGGCGGCGGATCAGGAGGACGCGCCTCTGGTGGTGGAGGATCCGGAGATCGTG ATGACCCAGAGCCCTCTCCTTGCCCGTGACTCCTGGGGAGCCCGCATCCAT TTCATGCCGGAGCTCCCAGTCACTTCTCTACTCCAACGGCTATAACTACGTGG ATTGGTACCTCCAAAAGCCGGGCCAGAGCCCGCAGCTGCTGATCTACCTGGGC TCGAACAGGGCCAGCGGAGTGCCTGACCGGTTCTCCGGGTCGGGAAGCGGGAC CGACTTCAAGCTGCAAATCTCGAGAGTGGAGGCCGAGGACGTGGGAATCTACT ACTGTATGCAGGGCCGCCAGTTTCCGTACTCGTTCGGACAGGGCACCAAAGTG GAAATCAAGACCACTACCCCAGCACCGAGGCCACCCACCCCGGCTCCTACCAT CGCCTCCCAGCCTCTGTCCCTGCGTCCGGAGGCATGTAGACCCGCAGCTGGTG GGGCCGTGCATACCCGGGGTCTTGACTTCGCCTGCGATATCTACATTTGGGCC CCTCTGGCTGGTACTTGCGGGGTCCTGCTGCTTTCACTCGTGATCACTCTTTA CTGTAAGCGCGGTCGGAAGAAGCTGCTGTACATCTTTAAGCAACCCTTCATGA GGCCTGTGCAGACTACTCAAGAGGAGGACGGCTGTTCATGCCGGTTCCCAGAG GAGGAGGAAGGCGGCTGCGAACTGCGCGTGAAATTCAGCCGCAGCGCAGATGC TCCAGCCTACAAGCAGGGGCAGAACCAGCTCTACAACGAACTCAATCTTGGTC GGAGAGAGGAGTACGACGTGCTGGACAAGCGGAGAGGACGGGACCCAGAAATG GGCGGGAAGCCGCGCAGAAAGAATCCCCAAGAGGGCCTGTACAACGAGCTCCA AAAGGATAAGATGGCAGAAGCCTATAGCGAGATTGGTATGAAGGGGAACGCA GAAGAGGCAAAGGCCACGACGGACTGTACCAGGGACTCAGCACCGCCACCAAG GACACCTATGACGCTCTTCACATGCAGGCCCTGCCGCCTCGG |

139104

| 139104- aa ScFv domain | 45 | EVQLLETGGGLVQPGGSLRLSCAVSGFALSNHGMSWVRRAPGKGLEWVSGIVY SGSTYYAASVKGRFTISRDNSRNTLYLQMNSLRPEDTAIYYCSAHGGESDVWG QGTTVTVSSASGGGGSGGRASGGGGSEIVLTQSPATLSVSPGESATLSCRASQ SVSSNLAWYQQKPGQAPRLLIYGASTRASGIPDRFSGSGSGTDFTLTISSLQA EDVAVYYCQQYGSSLTFGGGTKVEIK |
| 139104- nt ScFv domain | 60 | GAAGTGCAATTGCTCGAAACTGGAGGAGGTCTGGTGCAACCTGGAGGATCACT TCGCCTGTCCTGCGCCGTGTCGGGCTTTGCCCTGTCCAACCATGGAATGAGCT GGGTCCGCCGCGCGCCGGGAAGGGCCTCGAATGGGTGTCCGGCATCGTCTAC TCCGGCTCCACCTACTACGCCGCGTCCGTGAAGGGCCGGTTCACGATTTCACG GGACAACTCGCGGAACACCCTGTACCTCCAAATGAATTCCCTTCGGCCGGAGG ATACTGCCATCTACTACTGCTCCGCCCACGGTGGCGAATCCGACGTCTGGGGC CAGGGAACCACCGTGACCGTGTCCAGCGCGTCCGGGGAGGAGGAAGCGGGGG TAGAGCATCGGGTGGAGGCGGATCAGAGATCGTGCTGACCCAGTCCCCCGCCA CCCTTGAGCGTGTCACCAGGAGAGTCCGCCACCCTGTCATGCCGCGCCAGCCAG TCCGTGTCCTCCAACCTGGCTTGGTACCAGCAGAAGCCGGGGCAGGCCCCTAG ACTCCTGATCTATGGGGCGTCGACCCGGGCATCTGGAATTCCCGATAGGTTCA GCGGATCGGGCTCGGGCACTGACTTCACTCTGACCATCTCCTCGCTGCAAGCC GAGGACGTGGCTGTGTACTACTGTCAGCAGTACGGAAGCTCCCTGACTTTCGG TGGCGGGACCAAAGTCGAGATTAAG |

TABLE 8-continued

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/Description | SEQ ID NO: | Sequence |
|---|---|---|
| 139104- aa VH | 75 | EVQLLETGGGLVQPGGSLRLSCAVSGFALSNHGMSWVRRAPGKGLEWVSGIVY SGSTYYAASVKGRFTISRDNSRNTLYLQMNSLRPEDTAIYYCSAHGGESDVWG QGTTVTVSS |
| 139104- aa VL | 90 | EIVLTQSPATLSVSPGESATLSCRASQSVSSNLAWYQQKPGQAPRLLIYGAST RASGIPDRFSGSGSGTDFTLTISSLQAEDVAVYYCQQYGSSLTFGGGTKVEIK |
| 139104- aa Full CAR | 105 | MALPVTALLLPLALLLHAARPEVQLLETGGGLVQPGGSLRLSCAVSGFALSNH GMSWVRRAPGKGLEWVSGIVYSGSTYYAASVKGRFTISRDNSRNTLYLQMNSL RPEDTAIYYCSAHGGESDVWGQGTTVTVSSASGGGGSGGRASGGGGSEIVLTQ SPATLSVSPGESATLSCRASQSVSSNLAWYQQKPGQAPRLLIYGASTRASGIP DRFSGSGSGTDFTLTISSLQAEDVAVYYCQQYGSSLTFGGGTKVEIKTTTPAP RPPTPAPTIASQPLSLRPEACRPAAGGAVHTRGLDFACDIYIWAPLAGTCGVL LLSLVITLYCKRGRKKLLYIFKQPFMRPVQTTQEEDGCSCRFPEEEEGGCELR VKFSRSADAPAYKQGQNQLYNELNLGRREEYDVLDKRRGRDPEMGGKPRRKNP QEGLYNELQKDKMAEAYSEIGMKGERRRGKGHDGLYQGLSTATKDTYDALHMQ ALPPR |
| 139104- nt Full CAR | 120 | ATGGCCCTCCCTGTCACCGCCCTGCTGCTTCCGCTGGCTCTTCTGCTCCACGC CGCTCGGCCCGAAGTGCAATTGCTCGAAACTGGAGGAGGTCTGGTGCAACCTG GAGGATCACTTCGCCTGTCCTGCGCCGTGTCGGGCTTTGCCCTGTCCAACCAT GGAATGAGCTGGGTCCGCCGCGCGCCGGGGAAGGGCCTCGAATGGGTGTCCGG CATCGTCTACTCCGGCTCCACCTACTACGCCGCGTCCGTGAAGGGCCGGTTCA CGATTTCACGGGACAACTCGCGGAACACCCTGTACCTCCAAATGAATTCCCTT CGGCCGGAGGATACTGCCATCTACTACTGCTCCGCCCACGGTGGCGAATCCGA CGTCTGGGGCCAGGGAACCACCGTGACCGTGTCCAGCGCGTCCGGGGGAGGAG GAAGCGGGGGTAGAGCATCGGGTGGAGGCGGATCAGAGATCGTGCTGACCCAG TCCCCCGCCACCTTGAGCGTGTCACCAGGAGAGTCCGCCACCCTGTCATGCCG CGCCAGCCAGTCCGTGTCCTCCAACCTGGCTTGGTACCAGCAGAAGCCGGGGC AGGCCCCTAGACTCCTGATCTATGGGGCGTCGACCCGGGCATCTGGAATTCCC GATAGGTTCAGCGGATCGGGCTCGGGCACTGACTTCACTCTGACCATCTCCTC GCTGCAAGCCGAGGACGTGGCTGTGTACTACTGTCAGCAGTACGGAAGCTCCC TGACTTTCGGTGGCGGGACCAAAGTCGAGATTAAGACCACTACCCCAGCACCG AGGCCACCCACCCCGGCTCCTACCATCGCCTCCCAGCCTCTGTCCCTGCGTCC GGAGGCATGTAGACCCGCAGCTGGTGGGGCCGTGCATACCCGGGGTCTTGACT TCGCCTGCGATATCTACATTTGGGCCCCTCTGGCTGGTACTTGCGGGGTCCTG CTGCTTTCACTCGTGATCACTCTTTACTGTAAGCGCGGTCGGAAGAAGCTGCT GTACATCTTTAAGCAACCCTTCATGAGGCCTGTGCAGACTACTCAAGAGGAGG ACGGCTGTTCATGCCGGTTCCCAGAGGAGGAGGAAGGCGGCTGCGAACTGCGC GTGAAATTCAGCCGCAGCGCAGATGCTCCAGCCTACAAGCAGGGGCAGAACCA GCTCTACAACGAACTCAATCTTGGTCGGAGAGAGGAGTACGACGTGCTGGACA AGCGGAGAGGACGGGACCCAGAAATGGGCGGGAAGCCGCGCAGAAAGAATCCC CAAGAGGGCCTGTACAACGAGCTCCAAAAGGATAAGATGGCAGAAGCCTATAG CGAGATTGGTATGAAAGGGGAACGCAGAAGAGGCAAAGGCCACGACGGACTGT ACCAGGGACTCAGCACCGCCACCAAGGACACCTATGACGCTCTTCACATGCAG GCCCTGCCGCCTCGG |

139106

| Name/Description | SEQ ID NO: | Sequence |
|---|---|---|
| 139106- aa ScFv domain | 46 | EVQLVETGGGLVQPGGSLRLSCAVSGFALSNHGMSWVRRAPGKGLEWVSGIVY SGSTYYAASVKGRFTISRDNSRNTLYLQMNSLRPEDTAIYYCSAHGGESDVWG QGTTVTVSSASGGGGSGGRASGGGGSEIVMTQSPATLSVSPGERATLSCRASQ SVSSKLAWYQQKPGQAPRLLMYGASIRATGIPDRFSGSGSGTEFTLTISSLEP EDFAVYYCQQYGSSSWTFGQGTKVEIK |
| 139106- nt ScFv domain | 61 | GAAGTGCAATTGGTGGAAACTGGAGGAGGACTTGTGCAACCTGGAGGATCATT GAGACTGAGCTGCGCAGTGTCGGGATTCGCCCTGAGCAACCATGGAATGTCCT GGGTCAGAAGGGCCCCTGGAAAAGGCCTCGAATGGGTGTCAGGGATCGTGTAC TCCGGTTCCACTTACTACGCCGCCTCCGTGAAGGGCGCTTCACTATCTCACG GATAACTCCCGCAATACCCTGTACCTCCAAATGAACAGCCTGCGGCCGGAGG ATACCGCCATCTACTACTGTTCCGCCCACGGTGGAGAGTCTGACGTCTGGGGC CAGGGAACTACCGTGACCGTGTCCTCCGCGTCCGGCGGTGGAGGGAGCGGCGG CCGCGCCAGCGGCGGCGGAGGCTCCGAGATCGTGATGACCCAGAGCCCCGCTA CTCTGTCGGTGTCGCCCGGAGAAAGGGCGACCCTGTCCTGCGGGCGTCGCAG TCCGTGAGCAGCAAGCTGGCTTGGTACCAGCAGAAGCCGGGCCAGGCACCACG CCTGCTTATGTACGGTGCCTCCATTCGGGCCACCGGAATCCCGGACCGGTTCT CGGGGTCGGGGTCCGGTACCGAGTTCACACTGACCATTTCCTCGCTCGAGCCC GAGGACTTTGCCGTCTATTACTGCCAGCAGTACGGCTCCTCCTCATGGACGTT CGGCCAGGGGACCAAGGTCGAAATCAAG |
| 139106- aa VH | 76 | EVQLVETGGGLVQPGGSLRLSCAVSGFALSNHGMSWVRRAPGKGLEWVSGIVY SGSTYYAASVKGRFTISRDNSRNTLYLQMNSLRPEDTAIYYCSAHGGESDVWG QGTTVTVSS |

TABLE 8-continued

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/<br>Description | SEQ<br>ID<br>NO: | Sequence |
|---|---|---|
| 139106- aa<br>VL | 91 | EIVMTQSPATLSVSPGERATLSCRASQSVSSKLAWYQQKPGQAPRLLMYGASI<br>RATGIPDRFSGSGSGTEFTLTISSLEPEDFAVYYCQQYGSSSWTFGQGTKVEI<br>K |
| 139106- aa<br>Full CAR | 106 | MALPVTALLLPLALLLHAARPEVQLVETGGGLVQPGGSLRLSCAVSGFALSNH<br>GMSWVRRAPGKGLEWVSGIVYSGSTYYAASVKGRFTISRDNSRNTLYLQMNSL<br>RPEDTAIYYCSAHGGESDVWGQGTTVTVSSASGGGGSGGRASGGGGSEIVMTQ<br>SPATLSVSPGERATLSCRASQSVSSKLAWYQQKPGQAPRLLMYGASIRATGIP<br>DRFSGSGSGTEFTLTISSLEPEDFAVYYCQQYGSSSWTFGQGTKVEIKTTTPA<br>PRPPTPAPTIASQPLSLRPEACRPAAGGAVHTRGLDFACDIYIWAPLAGTCGV<br>LLLSLVITLYCKRGRKKLLYIFKQPFMRPVQTTQEEDGCSCRFPEEEEGGCEL<br>RVKFSRSADAPAYKQGQNQLYNELNLGRREEYDVLDKRRGRDPEMGGKPRRKN<br>PQEGLYNELQKDKMAEAYSEIGMKGERRRGKGHDGLYQGLSTATKDTYDALHM<br>QALPPR |
| 139106- nt<br>Full CAR | 121 | ATGGCCCTCCCTGTCACCGCCCTGCTGCTTCCGCTGGCTCTTCTGCTCCACGC<br>CGCTCGGCCCGAAGTGCAATTGGTGGAAACTGGAGGAGGAGGACTTGTGCAACCTG<br>GAGGATCATTGAGACTGAGCTGCGCAGTGTCGGGATTCGCCCTGAGCAACCAT<br>GGAATGTCCTGGGTCAGAAGGGCCCCTGGAAAAGGCCTCGAATGGGTGTCAGG<br>GATCGTGTACTCCGGTTCCACTTACTACGCCGCCTCCGTGAAGGGGCGCTTCA<br>CTATCTCACGGGATAACTCCCGCAATACCCTGTACCTCCAAATGAACAGCCTG<br>CGGCCGGAGGATACCGCCATCTACTACTGTTCCGCCCACGGTGGAGAGTCTGA<br>CGTCTGGGGCCAGGGAACTACCGTGACCGTGTCCTCCGCGTCCGGCGGTGGAG<br>GGAGCGGCGGCCGCGCCAGCGGCGGCGGAGGCTCCGAGATCGTGATGACCCAG<br>AGCCCCGCTACTCTGTCGGTGTCGCCCGGAGAAAGGGCGACCCTGTCCTGCCG<br>GGCGTCGCAGTCCGTGAGCAGCAAGCTGGCTTGGTACCAGCAGAAGCCGGGCC<br>AGGCACCACGCCTGCTTATGTACGGTGCCTCCATTCGGGCCACCGGAATCCCG<br>GACCGGTTCTCGGGGTCGGGGTCCGGTACCGAGTTCACACTGACCATTTCCTC<br>GCTCGAGCCCGAGGACTTTGCCGTCTATTACTGCCAGCAGTACGGCTCCTCCT<br>CATGGACGTTCGGCCAGGGGACCAAGGTCGAAATCAAGACCACTACCCCAGCA<br>CCGAGGCCACCCACCCCGGCTCCTACCATCGCCTCCCAGCCTCTGTCCCTGCG<br>TCCGAGGCATGTAGACCCGCAGCTGGTGGGGCCGTGCATACCCGGGTCTTG<br>ACTTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAGCT<br>GCTGTACATCTTTAAGCAACCCTTCATGAGGCCTGTGCAGACTACTCAAGAGG<br>AGGACGGCTGTTCATGCCGGTTCCCAGAGGAGGAGGAAGGCGGCTGCGAACTG<br>CGCGTGAAATTCAGCCGCAGCGCAGATGCTCCAGCCTACAAGCAGGGGCAGAA<br>CCAGCTCTACAACGAACTCAATCTTGGTCGGAGAGAGGAGTACGACGTGCTGG<br>ACAAGCGGAGAGGACGGGACCCAGAAATGGGCGGGAAGCCGCGCAGAAAGAAT<br>CCCCAAGAGGGCCTGTACAACGAGCTCCAAAAGGATAAGATGGCAGAAGCCTA<br>TAGCGAGATTGGTATGAAAGGGGAACGCAGAAGAGGCAAAGGCCACGACGGAC<br>TGTACCAGGGACTCAGCACCGCCACCAAGGACACCTATGACGCTCTTCACATG<br>CAGGCCCTGCCGCCTCGG |

139107

| 139107- aa<br>ScFv domain | 47 | EVQLVETGGGVVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSSASGGGGSGGRASGGGGSEIVLTQSPGTLSLSPGERATLSCRASQ<br>SVGSTNLAWYQQKPGQAPRLLIYDASNRATGIPDRFSGGGSGTDFTLTISRLE<br>PEDFAVYYCQQYGSSPPWTFGQGTKVEIK |
| 139107- nt<br>ScFv domain | 62 | GAAGTGCAATTGGTGGAGACTGGAGGAGGAGTGGTGCAACCTGGAGGAAGCCT<br>GAGACTGTCATGCGCGGTGTCGGGCTTCGCCCTCTCCAACCACGGAATGTCCT<br>GGGTCGCCGGGCCCCTGGGAAAGGACTTGAATGGGTGTCCGGCATCGTGTAC<br>TCGGGTTCCACCTACTACGCGGCCTCAGTGAAGGGCCGGTTTACTATTAGCCG<br>CGACAACTCCAGAAACACACTGTACCTCCAAATGAACTCGCTGCGGCCGGAAG<br>ATACCGCTATCTACTACTGCTCCGCCCATGGGGAGAGTCGGACGTCTGGGGA<br>CAGGGCACCACTGTCACTGTGTCCAGCGCTTCCGGCGGTGGTGGAAGCGGGGG<br>ACGGGCCTCAGGAGGCGGTGGCAGCGAGATTGTGCTGACCCAGTCCCCCGGGA<br>CCCTGAGCCTGTCCCCGGGAGAAAGGGCCACCCTCTCCTGTCGGGCATCCCAG<br>TCCGTGGGGTCTACTAACCTTGCATGGTACCAGCAGAAGCCCGGCCAGGCCCC<br>TCGCCTGCTGATCTACGACGCGTCCAATAGAGCCACCGGCATCCCGGATCGCT<br>TCAGCGGAGGCGGATCGGGCACCGACTTCACCCTCACCATTTCAAGGCTGGAA<br>CCGGAGGACTTCGCCGTGTACTACTGCCAGCAGTATGGTTCGTCCCCACCCTG<br>GACGTTCGGCCAGGGGACTAAGGTCGAGATCAAG |
| 139107- aa<br>VH | 77 | EVQLVETGGGVVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSS |
| 139107- aa<br>VL | 92 | EIVLTQSPGTLSLSPGERATLSCRASQSVGSTNLAWYQQKPGQAPRLLIYDAS<br>NRATGIPDRFSGGGSGTDFTLTISRLEPEDFAVYYCQQYGSSPPWTFGQGTKV<br>EIK |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| 139107- aa<br>Full CAR | 107 | MALPVTALLLPLALLLHAARPEVQLVETGGGVVQPGGSLRLSCAVSGFALSNH<br>GMSWVRRAPGKGLEWVSGIVYSGSTYYAASVKGRFTISRDNSRNTLYLQMNSL<br>RPEDTAIYYCSAHGGESDVWGQGTTVTVSSASGGGSGGRASGGGSEIVLTQ<br>SPGTLSLSPGERATLSCRASQSVGSTNLAWYQQKPGQAPRLLIYDASNRATGI<br>PDRFSGGGSGTDFTLTISRLEPEDFAVYYCQQYGSSPPWTFGQGTKVEIKTTT<br>PAPRPPTPAPTIASQPLSLRPEACRPAAGGAVHTRGLDFACDIYIWAPLAGTC<br>GVLLLSLVITLYCKRGRKKLLYIFKQPFMRPVQTTQEEDGCSCRFPEEEGGC<br>ELRVKFSRSADAPAYKQGQNQLYNELNLGRREEYDVLDKRRGRDPEMGGKPRR<br>KNPQEGLYNELQKDKMAEAYSEIGMKGERRRGKGHDGLYQGLSTATKDTYDAL<br>HMQALPPR |
| 139107- nt<br>Full CAR | 122 | ATGGCCCTCCCTGTCACCGCCCTGCTGCTTCCGCTGGCTCTTCTGCTCCACGC<br>CGCTCGGCCCGAAGTGCAATTGGTGGAGACTGGAGGAGGAGTGGTGCAACCTG<br>GAGGAAGCCTGAGACTGTCATGCGCGGTGTCGGGCTTCGCCCTCTCCAACCAC<br>GGAATGTCCTGGGTCCGCCGGGCCCCTGGGAAAGGACTTGAATGGGTGTCCGG<br>CATCGTGTACTCGGGTTCCACCTACTACGCGGCCTCAGTGAAGGGCCGGTTTA<br>CTATTAGCCGCGACAACTCCAGAAACACACTGTACCTCCAAATGAACTCGCTG<br>CGGCCGGAAGATACCGCTATCTACTACTGCTCCGCCCATGGGGGAGAGTCGGA<br>CGTCTGGGGACAGGGCACCACTGTCACTGTGTCCAGCGCTTCCGGCGGTGGTG<br>GAAGCGGGGGACGGGCCTCAGGAGGCGGTGGCAGCGAGATTGTGCTGACCCAG<br>TCCCCCGGGACCCTGAGCCTGTCCCCGGGAGAAAGGGCCACCCTCTCCTGTCG<br>GGCATCCCAGTCCGTGGGGTCTACTAACCTTGCATGGTACCAGCAGAAGCCCG<br>GCCAGGCCCCTCGCCTGCTGATCTACGACGCGTCCAATAGAGCCACCGGCATC<br>CCGGATCGCTTCAGCGGAGGCGGATCGGGCACCGACTTCACCCTCACCATTTC<br>AAGGCTGGAACCGGAGGACTTCGCCGTGTACTACTGCCAGCAGTATGGTTCGT<br>CCCCACCCTGGACGTTCGGCCAGGGGACTAAGGTCGAGATCAAGACCACTACC<br>CCAGCACCGAGGCCACCCACCCCGGCTCCTACCATCGCCTCCCAGCCTCTGTC<br>CCTGCGTCCGGAGGCATGTAGACCCGCAGCTGGTGGGGCCGTGCATACCCGGG<br>GTCTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGGAA<br>GAAGCTGCTGTACATCTTTAAGCAACCCTTCATGAGGCCTGTGCAGACTACTC<br>AAGAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAGGG<br>GCAGAACCAGCTCTACAACGAACTCAATCTTGGTCGGAGAGAGGAGTACGACG<br>TGCTGGACAAGCGGAGAGGACGGGACCCAGAAATGGGCGGGAAGCCGCGCAGA<br>AAGAATCCCAAGAGGGCCTGTACAACGAGCTCCAAAAGGATAAGATGGCAGA<br>AGCCTATAGCGAGATTGGTATGAAAGGGGAACGCAGAAGAGGCAAAGGCCACG<br>ACGGACTGTACCAGGGACTCAGCACCGCCACCAAGGACACCTATGACGCTCTT<br>CACATGCAGGCCCTGCCGCCTCGG |

139108

| 139108- aa<br>ScFv domain | 48 | QVQLVESGGGLVKPGGSLRLSCAASGFTFSDYYMSWIRQAPGKGLEWVSYISS<br>SGSTIYYADSVKGRFTISRDNAKNSLYLQMNSLRAEDTAVYYCARESGDGMDV<br>WGQGTTVTVSSASGGGGSGGRASGGGGSDIQMTQSPSSLSASVGDRVTITCRA<br>SQSISSYLNWYQQKPGKAPKLLIYAASSLQSGVPSRFSGSGSGTDFTLTISSL<br>QPEDFATYYCQQSYTLAFGQGTKVDIK |
| 139108- nt<br>ScFv domain | 63 | CAAGTGCAACTCGTGGAATCTGGTGGAGGACTCGTGAAACCTGGAGGATCATT<br>GAGACTGTCATGCGCGGCCTCGGGATTCACGTTCTCCGATTACTACATGAGCT<br>GGATTCGCCAGGCTCCGGGGAAGGGACTGGAATGGGTGTCCTACATTTCCTCA<br>TCCGGCTCCACCATCTACTACGCGGACTCCGTGAAGGGGAGATTCACCATTAG<br>CCGCGATAACGCCAAGAACAGCCTGTACCTTCAGATGAACTCCCTGCGGGCTG<br>AAGATACTGCCGTCTACTACTGCGCAAGGGAGAGCGGAGATGGGATGGACGTC<br>TGGGGACAGGGTACCACTGTGACCGTGTCGTCGGCCTCCGGCGGAGGGGGTTC<br>GGGTGGAAGGGCCAGCGGCGGCGGAGGCAGCGACATCCAGATGACCCAGTCCC<br>CCTCATCGCTGTCCGCCTCCGTGGGCGACCGCGTCACCATCACATGCCGGGCC<br>TCACAGTCGATCTCCTCCTACCTCAATTGGTATCAGCAGAAGCCCGGAAAGGC<br>CCCTAAGCTTCTGATCTACGCAGCGTCCTCCCTGCAATCCGGGGTCCCATCTC<br>GGTTCTCCGGCTCGGGCAGCGGTACCGACTTCACTCTGACCATCTCGAGCCTG<br>CAGCCGGAGGACTTCGCCACTTACTACTGTCAGCAAAGCTACACCCTCGCGTT<br>TGGCCAGGGCACCAAAGTGGACATCAAG |
| 139108- aa<br>VH | 78 | QVQLVESGGGLVKPGGSLRLSCAASGFTFSDYYMSWIRQAPGKGLEWVSYISS<br>SGSTIYYADSVKGRFTISRDNAKNSLYLQMNSLRAEDTAVYYCARESGDGMDV<br>WGQGTTVTVSS |
| 139108- aa<br>VL | 93 | DIQMTQSPSSLSASVGDRVTITCRASQSISSYLNWYQQKPGKAPKLLIYAASS<br>LQSGVPSRFSGSGSGTDFTLTISSLQPEDFATYYCQQSYTLAFGQGTKVDIK |
| 139108- aa<br>Full CAR | 108 | MALPVTALLLPLALLLHAARPQVQLVESGGGLVKPGGSLRLSCAASGFTFSDY<br>YMSWIRQAPGKGLEWVSYISSSGSTIYYADSVKGRFTISRDNAKNSLYLQMNS<br>LRAEDTAVYYCARESGDGMDVWGQGTTVTVSSASGGGGSGGRASGGGGSDIQM<br>TQSPSSLSASVGDRVTITCRASQSISSYLNWYQQKPGKAPKLLIYAASSLQSG<br>VPSRFSGSGSGTDFTLTISSLQPEDFATYYCQQSYTLAFGQGTKVDIKTTTPA |

TABLE 8-continued

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/ Description | SEQ ID NO: | Sequence |
|---|---|---|
| | | PRPPTPAPTIASQPLSLRPEACRPAAGGAVHTRGLDFACDIYIWAPLAGTCGV LLLSLVITLYCKRGRKKLLYIFKQPFMRPVQTTQEEDGCSCRFPEEEEGGCEL RVKFSRSADAPAYKQGQNQLYNELNLGRREEYDVLDKRRGRDPEMGGKPRRKN PQEGLYNELQKDKMAEAYSEIGMKGERRRGKHDGLYQGLSTATKDTYDALHM QALPPR |
| 139108- nt Full CAR | 123 | ATGGCCCTCCCTGTCACCGCCCTGCTGCTTCCGCTGGCTCTTCTGCTCCACGC CGCTCGGCCCCAAGTGCAACTCGTGGAATCTGGTGGAGGACTCGTGAAACCTG GAGGATCATTGAGACTGTCATGCGCGGCCTCGGGATTCACGTTCTCCGATTAC TACATGAGCTGGATTCGCCAGGCTCCGGGGAAGGGACTGGAATGGGTGTCCTA CATTTCCTCATCCGGCTCCACCATCTACTACGCGGACTCCGTGAAGGGGGAGAT TCACCATTAGCCGCGATAACGCCAAGAACAGCCTGTACCTTCAGATGAACTCC CTGCGGGCTGAAGATACTGCCGTCTACTACTGCGCAAGGGAGAGCGGAGATGG GATGGACGTCTGGGGACAGGGTACCACTGTGACCGTGTCGTCGGCCTCCGGCG GAGGGGGTTCGGGTGGAAGGGCCAGCGGCGGCGGAGGCAGCGACATCCAGATG ACCCAGTCCCCCTCATCGCTGTCCGCCTCCGTGGGCGACCGCGTCACCATCAC ATGCCGGGCCTCACAGTCGATCTCCTCCTACCTCAATTGGTATCAGCAGAAGC CCGGAAAGGCCCCTAAGCTTCTGATCTACGCAGCGTCCTCCCTGCAATCCGGG GTCCCATCTCGGTTCTCCGGCTCGGGCAGCGGTACCGACTTCACTCTGACCAT CTCGAGCCTGCAGCCGGAGGACTTCGCCACTTACTACTGTCAGCAAAGCTACA CCCTCGCGTTTGGCCAGGGCACCAAAGTGGACATCAAGACCACTACCCCAGCA CCGAGGCCACCCACCCCGGCTCCTACCATCGCCTCCCAGCCTCTGTCCCTGCG TCCGGAGGCATGTAGACCCGCAGCTGGTGGGGCCGTGCATACCCGGGGTCTTG ACTTCGCCTGCGATATCTACATTTGGGCCCCTCTGGCTGGTACTTGCGGGGTC CTGCTGCTTTCACTCGTGATCACTCTTTACTGTAAGCGCGGTCGGAAGAAGCT GCTGTACATCTTTAAGCAACCCTTCATGAGGCCTGTGCAGACTACTCAAGAGG AGGACGGCTGTTCATGCCGGTTCCCAGAGGAGGAGGAAGGCGGCTGCGAACTG CGCGTGAAATTCAGCCGCAGCGCAGATGCTCCAGCCTACAAGCAGGGGCAGAA CCAGCTCTACAACGAACTCAATCTTGGTCGGAGAGAGGAGTACGACGTGCTGG ACAAGCGGAGAGGACGGGACCCAGAAATGGGCGGGAAGCCGCGCAGAAAGAAT CCCCAAGAGGGCCTGTACAACGAGCTCCAAAAGGATAAGATGGCAGAAGCCTA TAGCGAGATTGGTATGAAAGGGGAACGCAGAAGAGGCAAAGGCCACGACGGAC TGTACCAGGGACTCAGCACCGCCACCAAGGACACCTATGACGCTCTTCACATG CAGGCCCTGCCGCCTCGG |

139110

| 139110- aa ScFv domain | 50 | QVQLVQSGGGLVKPGGSLRLSCAASGFTFSDYYMSWIRQAPGKGLEWVSYISS SGNTIYYADSVKGRFTISRDNAKNSLYLQMNSLRAEDTAVYYCARSTMVREDY WGQGTLVTVSSASGGGGSGGRASGGGGSDIVLTQSPLSLPVTLGQPASISCKS SESLVHNSGKTYLNWFHQRPGQSPRRLIYEVSNRDSGVPDRFTGSGSGTDFTL KISRVEAEDVGVYYCMQGTHWPGTFGQGTKLEIK |
| 139110- nt ScFv domain | 65 | CAAGTGCAACTGGTGCAAAGCGGAGGAGGATTGGTCAAACCCGGAGGAAGCCT GAGACTGTCATGCGCGGCCTCTGGATTCACCTTCTCCGATTACTACATGTCAT GGATCAGACAGGCCCCGGGAAGGGCCTCGAATGGGTGTCTACATCTCGTCC TCCGGGAACACCATCTACTACGCCGACAGCGTGAAGGGCCGCTTTACCATTTC CCGCGACAACGCAAAGAACTCGCTGTACCTTCAGATGAATTCCCTGCGGGCTG AAGATACCGCGGTGTACTATTGCGCCCGGTCCACTATGGTCCGGGAGGACTAC TGGGGACAGGGCACACTCGTGACCGTGTCCAGCGCGAGCGGGGGTGGAGGCAG CGGTGGACGCGCCTCCGGCGGCGGCGGTTCAGACATCGTGCTGACTCAGTCGC CCCTGTCGCTGCCGGTCACCCTGGGCCAACCGGCCTCAATTAGCTGCAAGTCC TCGGAGAGCCTGGTGCACAACTCAGGAAAGACTTACCTGAACTGGTTCCATCA GCGGCCTGGACAGTCCCCACGGAGGCTCATCTATGAAGTGTCCAACAGGGATT CGGGGGTGCCCGACCGCTTCACTGGCTCCGGGTCCGGCACCGACTTCACCTTG AAAATCTCCAGAGTGGAAGCCGAGGACGTGGGCGTGTACTACTGTATGCAGGG TACCCACTGGCCTGGAACCTTTGGACAAGGAACTAAGCTCGAGATTAAG |
| 139110- aa VH | 80 | QVQLVQSGGGLVKPGGSLRLSCAASGFTFSDYYMSWIRQAPGKGLEWVSYISS SGNTIYYADSVKGRFTISRDNAKNSLYLQMNSLRAEDTAVYYCARSTMVREDY WGQGTLVTVSS |
| 139110- aa VL | 95 | DIVLTQSPLSLPVTLGQPASISCKSSESLVHNSGKTYLNWFHQRPGQSPRRLI YEVSNRDSGVPDRFTGSGSGTDFTLKISRVEAEDVGVYYCMQGTHWPGTFGQG TKLEIK |
| 139110- aa Full CAR | 110 | MALPVTALLLPLALLLHAARPQVQLVQSGGGLVKPGGSLRLSCAASGFTFSDY YMSWIRQAPGKGLEWVSYISSSGNTIYYADSVKGRFTISRDNAKNSLYLQMNS LRAEDTAVYYCARSTMVREDYWGQGTLVTVSSASGGGGSGGRASGGGGSDIVL TQSPLSLPVTLGQPASISCKSSESLVHNSGKTYLNWFHQRPGQSPRRLIYEVS NRDSGVPDRFTGSGSGTDFTLKISRVEAEDVGVYYCMQGTHWPGTFGQGTKLE IKTTTPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCRFPEE EEGGCELRVKFSRSADAPAYKQGQNQLYNELNLGRREEYDVLDKRRGRDPEMG GKPRRKNPQEGLYNELQKDKMAEAYSEIGMKGERRRGKHDGLYQGLSTATKD |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| | | TYDALHMQALPPR |
| 139110- nt Full CAR | 125 | ATGGCCCTCCCTGTCACCGCCCTGCTGCTTCCGCTGGCTCTTCTGCTCCACGC CGCTCGGCCCCAAGTGCAACTGGTGCAAAGCGGAGGAGGATTGGTCAAACCCG GAGGAAGCCTGAGACTGTCATGCGCGGCCTCTGGATTCACCTTCTCCGATTAC TACATGTCATGGATCAGACAGGCCCCGGGGAAGGGCCTCGAATGGGTGTCCTA CATCTCGTCCTCCGGGAACACCATCTACTACGCCGACAGCGTGAAGGGCCGCT TTACCATTTCCCGCGACAACGCAAAGAACTCGCTGTACCTTCAGATGAATTCC CTGCGGGCTGAAGATACCGCGGTGTACTATTGCGCCCGGTCCACTATGGTCCG GGAGGACTACTGGGGACAGGGCACACTCGTGACCGTGTCCAGCGCGAGCGGGG GTGGAGGCAGCGGTGGACGCGCCTCCGGCGGCGGCGGTTCAGACATCGTGCTG ACTCAGTCGCCCCTGTCGCTGCCGGTCACCCTGGGCCAACCGGCCTCAATTAG CTGCAAGTCCTCGGAGAGCCTGGTGCACAACTCAGGAAAGACTTACCTGAACT GGTTCCATCAGCGGCCTGGACAGTCCCCACGGAGGCTCATCTATGAAGTGTCC AACAGGGATTCGGGGGTGCCCGACCGCTTCACTGGCTCCGGGTCCGGCACCGA CTTCACCTTGAAAATCTCCAGAGTGGAAGCCGAGGACGTGGGCGTGTACTACT GTATGCAGGGTACCCACTGGCCTGGAACCTTTGGACAAGGAACTAAGCTCGAG ATTAAGACCACTACCCCAGCACCGAGGCCACCCACCCCGGCTCCTACCATCGC CTCCCAGCCTCTGTCCCTGCGTCCGGAGGCATGTAGACCCGCAGCTGGTGGGG CCGTGCATACCCGGGGTCTTGACTTCGCCTGCGATATCTACATTTGGGCCCCT CTGGCTGGTACTTGCGGGGTCCTGCTGCTTTCACTCGTGATCACTCTTTACTG TAAGCGCGGTCGGAAGAAGCTGCTGTACATCTTTAAGCAACCCTTCATGAGGC CTGTGCAGACTACTCAAGAGGAGGACGGCTGTTCATGCCGGTTCCCAGAGGAG GAGGAAGGCGGCTGCGAACTGCGCGTGAAATTCAGCCGCAGCGCAGATGCTCC AGCCTACAAGCAGGGGCAGAACCAGCTCTACAACGAACTCAATCTTGGTCGGA GAGAGGAGTACGACGTGCTGGACAAGCGGAGAGGACGGGACCCAGAAATGGGC GGGAAGCCGCGCAGAAAGAATCCCCAAGAGGGCCTGTACAACGAGCTCCAAAA GGATAAGATGGCAGAAGCCTATAGCGAGATTGGTATGAAAGGGGAACGCAGAA GAGGCAAAGGCCACGACGGACTGTACCAGGGACTCAGCACCGCCACCAAGGAC ACCTATGACGCTCTTCACATGCAGGCCCTGCCGCCTCGG |

139112

| 139112- aa ScFv domain | 51 | QVQLVESGGGLVQPGGSLRLSCAVSGFALSNHGMSWVRRAPGKGLEWVSGIVY SGSTYYAASVKGRFTISRDNSRNTLYLQMNSLRPEDTAIYYCSAHGGESDVWG QGTTVTVSSASGGGGSGGRASGGGGSDIRLTQSPSPLSASVGDRVTITCQASE DINKFLNWYHQTPGKAPKLLIYDASTLQTGVPSRFSGSGSGTDFTLTINSLQP EDIGTYYCQQYESLPLTFGGGTKVEIK |
| 139112- nt ScFv domain | 66 | CAAGTGCAACTCGTGGAATCTGGTGGAGGACTCGTGCAACCCGGTGGAAGCCT TAGGCTGTCGTGCGCCGTCAGCGGGTTTGCTCTGAGCAACCATGGAATGTCCT GGGTCCGCCGGGCACCGGGAAAAGGGCTGGAATGGGTGTCCGGCATCGTGTAC AGCGGGTCAACCTATTACGCCGCGTCCGTGAAGGGCAGATTCACTATCTCAAG AGACAACAGCCGGAACACCCTGTACTTGCAAATGAATTCCCTGCGCCCCGAGG ACACCGCCATCTACTACTGCTCCGCCCACGGAGGAGAGTCGGACGTGTGGGGC CAGGGAACGACTGTGACTGTGTCCAGCGCATCAGGAGGGGGTGGTTCGGGCGG CCGGGCCTCGGGGGAGGAGGTTCCGACATTCGGCTGACCCAGTCCCCGTCCC CACTGTCGGCCTCCGTCGGCGACCGCGTGACCATCACTTGTCAGGCGTCCGAG GACATTAACAAGTTCCTGAACTGGTACCACCAGACCCCTGGAAAGGCCCCCAA GCTGCTGATCTACGATGCCTCGACCCTTCAAACTGGAGTGCCTAGCCGGTTCT CCGGGTCCGGCTCCGGCACTGATTTCACTCTGACCATCAACTCATTGCAGCCG GAAGATATCGGGACCTACTATTGCCAGCAGTACGAATCCCTCCCGCTCACATT CGGCGGGGGAACCAAGGTCGAGATTAAG |
| 139112- aa VH | 81 | QVQLVESGGGLVQPGGSLRLSCAVSGFALSNHGMSWVRRAPGKGLEWVSGIVY SGSTYYAASVKGRFTISRDNSRNTLYLQMNSLRPEDTAIYYCSAHGGESDVWG QGTTVTVSS |
| 139112- aa VL | 96 | DIRLTQSPSPLSASVGDRVTITCQASEDINKFLNWYHQTPGKAPKLLIYDAST LQTGVPSRFSGSGSGTDFTLTINSLQPEDIGTYYCQQYESLPLTFGGGTKVEI K |
| 139112- aa Full CAR | 111 | MALPVTALLLPLALLLHAARPQVQLVESGGGLVQPGGSLRLSCAVSGFALSNH GMSWVRRAPGKGLEWVSGIVYSGSTYYAASVKGRFTISRDNSRNTLYLQMNSL RPEDTAIYYCSAHGGESDVWGQGTTVTVSSASGGGGSGGRASGGGGSDIRLTQ SPSPLSASVGDRVTITCQASEDINKFLNWYHQTPGKAPKLLIYDASTLQTGVP SRFSGSGSGTDFTLTINSLQPEDIGTYYCQQYESLPLTFGGGTKVEIKTTTPA PRPPTPAPTIASQPLSLRPEACRPAAGGAVHTRGLDFACDIYIWAPLAGTCGV LLLSLVITLYCKRGRKKLLYIFKQPFMRPVQTTQEEDGCSCRFPEEEEGGCEL RVKFSRSADAPAYKQGQNQLYNELNLGRREEYDVLDKRRGRDPEMGGKPRRKN PQEGLYNELQKDKMAEAYSEIGMKGERRRGKGHDGLYQGLSTATKDTYDALHM QALPPR |
| 139112- nt Full CAR | 126 | ATGGCCCTCCCTGTCACCGCCCTGCTGCTTCCGCTGGCTCTTCTGCTCCACGC CGCTCGGCCCCAAGTGCAACTCGTGGAATCTGGTGGAGGACTCGTGCAACCCG GTGGAAGCCTTAGGCTGTCGTGCGCCGTCAGCGGGTTTGCTCTGAGCAACCAT |

TABLE 8-continued

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/<br>Description | SEQ<br>ID<br>NO: | Sequence |
|---|---|---|
| | | GGAATGTCCTGGGTCCGCCGGGCACCGGGAAAAGGGCTGGAATGGGTGTCCGG<br>CATCGTGTACAGCGGGTCAACCTATTACGCCGCGTCCGTGAAGGGCAGATTCA<br>CTATCTCAAGAGACAACAGCCGGAACACCCTGTACTTGCAAATGAATTCCCTG<br>CGCCCCGAGGACACCGCCATCTACTACTGCTCCGCCCACGGAGGAGAGTCGGA<br>CGTGTGGGGCCAGGGAACGACTGTGACTGTGTCCAGCGCATCAGGAGGGGGTG<br>GTTCGGGCGGCCGGGCCTCGGGGGAGGAGGTTCCGACATTCGGCTGACCCAG<br>TCCCCGTCCCCACTGTCGGCCTCCGTCGGCGACCGCGTGACCATCACTTGTCA<br>GGCGTCCGAGGACATTAACAAGTTCCTGAACTGGTACCACCAGACCCCTGGAA<br>AGGCCCCCAAGCTGCTGATCTACGATGCCTCGACCCTTCAAACTGGAGTGCCT<br>AGCCGGTTCTCCGGGTCCGGCTCCGGCACTGATTTCACTCTGACCATCAACTC<br>ATTGCAGCCGGAAGATATCGGGACCTACTATTGCCAGCAGTACGAATCCCTCC<br>CGCTCACATTCGGCGGGGAACCAAGGTCGAGATTAAGACCACTACCCCAGCA<br>CCCGAGGCCACCCACCCCGGCTCCTACCATCGCCTCCCAGCCTCTGTCCCTGCG<br>TCCGGAGGCATGTAGACCCGCAGCTGGTGGGGCCGTGCATACCCGGGTCTTG<br>ACTTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAGCT<br>GCTGTACATCTTTAAGCAACCCTTCATGAGGCCTGTGCAGACTACTCAAGAGG<br>AGGACGGCTGTTCATGCCGGTTCCCAGAGGAGGAGGAAGGCGGCTGCGAACTG<br>CGCGTGAAATTCAGCCGCAGCGCAGATGCTCCAGCCTACAAGCAGGGCAGAA<br>CCAGCTCTACAACGAACTCAATCTTGGTCGGAGAGAGGAGTACGACGTGCTGG<br>ACAAGCGGAGAGGACGGGACCCAGAAATGGGCGGGAAGCCGCGCAGAAAGAAT<br>CCCCAAGAGGGCCTGTACAACGAGCTCCAAAAGGATAAGATGGCAGAAGCCTA<br>TAGCGAGATTGGTATGAAAGGGGAACGCAGAAGAGGCAAAGGCCACGACGGAC<br>TGTACCAGGGACTCAGCACCGCCACCAAGGACACCTATGACGCTCTTCACATG<br>CAGGCCCTGCCGCCTCGG |
| | | 139113 |
| 139113- aa<br>ScFv domain | 52 | EVQLVETGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSSASGGGGSGGRASGGGGSETTLTQSPATLSVSPGERATLSCRASQ<br>SVGSNLAWYQQKPGQGPRLLIYGASTRATGIPARFSGSGSGTEFTLTISSLQP<br>EDFAVYYCQQYNDWLPVTFGQGTKVEIK |
| 139113- nt<br>ScFv domain | 67 | GAAGTGCAATTGGTGGAAACTGGAGGAGGACTTGTGCAACCTGGAGGATCATT<br>GCGGCTCTCATGCGCTGTCTCCGGCTTCGCCCTGTCAAATCACGGGATGTCGT<br>GGGTCAGACGGGCCCCGGGAAAGGGTCTGGAATGGGTGTCGGGGATTGTGTAC<br>AGCGGCTCCACCTACTACGCCGCTTCGGTCAAGGGCCGCTTCACTATTTCACG<br>GGACAACAGCCGCAACACCCTCTATCTGCAAATGAACTCTCTCCGCCCCGGAGG<br>ATACCGCCATCTACTACTGCTCCGCACACGGCGGCGAATCCGACGTGTGGGGA<br>CAGGGAACCACTGTCACCGTGTCGTCCGCATCCGGTGGCGGAGGATCGGGTGG<br>CCGGGCCTCCGGGGGCGGCGGCAGCGAGACTACCCTGACCCAGTCCCCTGCCA<br>CTCTGTCCGTGAGCCCGGGAGAGAGAGCCACCCTTAGCTGCCGGGCCAGCCAG<br>AGCGTGGGCTCCAACCTGGCCTGGTACCAGCAGAAGCCAGGACAGGGTCCCAG<br>GCTGCTGATCTACGGAGCCTCCACTCGCGCGACCGGCATCCCCGCGAGGTTCT<br>CCGGGTCGGGTTCCGGGACCGAGTTCACCCTGACCATCTCCTCCCTCCAACCG<br>GAGGACTTCGCGGTGTACTACTGTCAGCAGTACAACGATTGGCTGCCCGTGAC<br>ATTTGGACAGGGGACGAAGGTGGAAATCAAA |
| 139113- aa<br>VH | 82 | EVQLVETGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSS |
| 139113- aa<br>VL | 97 | ETTLTQSPATLSVSPGERATLSCRASQSVGSNLAWYQQKPGQGPRLLIYGAST<br>RATGIPARFSGSGSGTEFTLTISSLQPEDFAVYYCQQYNDWLPVTFGQGTKVE<br>IK |
| 139113- aa<br>Full CAR | 112 | MALPVTALLLPLALLLHAARPEVQLVETGGGLVQPGGSLRLSCAVSGFALSNH<br>GMSWVRRAPGKGLEWVSGIVYSGSTYYAASVKGRFTISRDNSRNTLYLQMNSL<br>RPEDTAIYYCSAHGGESDVWGQGTTVTVSSASGGGGSGGRASGGGGSETTLTQ<br>SPATLSVSPGERATLSCRASQSVGSNLAWYQQKPGQGPRLLIYGASTRATGIP<br>ARFSGSGSGTEFTLTISSLQPEDFAVYYCQQYNDWLPVTFGQGTKVEIKTTTP<br>APRPPTPAPTIASQPLSLRPEACRPAAGGAVHTRGLDFACDIYIWAPLAGTCG<br>VLLLSLVITLYCKRGRKKLLYIFKQPFMRPVQTTQEEDGCSCRFPEEEEGGCE<br>LRVKFSRSADAPAYKQGQNQLYNELNLGRREEYDVLDKRRGRDPEMGGKPRRK<br>NPQEGLYNELQKDKMAEAYSEIGMKGERRRGKGHDGLYQGLSTATKDTYDALH<br>MQALPPR |
| 139113- nt<br>Full CAR | 127 | ATGGCCCTCCCTGTCACCGCCCTGCTGCTTCCGCTGGCTCTTCTGCTCCACGC<br>CGCTCGGCCCGAAGTGCAATTGGTGGAAACTGGAGGAGGACTTGTGCAACCTG<br>GAGGATCATTGCGGCTCTCATGCGCTGTCTCCGGCTTCGCCCTGTCAAATCAC<br>GGGATGTCGTGGGTCAGACGGGCCCCGGGAAAGGGTCTGGAATGGGTGTCGGG<br>GATTGTGTACAGCGGCTCCACCTACTACGCCGCTTCGGTCAAGGGCCGCTTCA<br>CTATTTCACGGGACAACAGCCGCAACACCCTCTATCTGCAAATGAACTCTCTC<br>CGCCCGGAGGATACCGCCATCTACTACTGCTCCGCACACGGCGGCGAATCCGA |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | CGTGTGGGGACAGGGAACCACTGTCACCGTGTCGTCCGCATCCGGTGGCGGAG<br>GATCGGGTGGCCGGGCCTCCGGGGGCGGCGGCAGCGAGACTACCCTGACCCAG<br>TCCCCTGCCACTCTGTCCGTGAGCCCGGGAGAGAGCCACCCTTAGCTGCCG<br>GGCCAGCCAGAGCGTGGGCTCCAACCTGGCCTGGTACCAGCAGAAGCCAGGAC<br>AGGGTCCCAGGCTGCTGATCTACGGAGCCTCCACTCGCGCGACCGGCATCCCC<br>GCGAGGTTCTCCGGGTCGGGTTCCGGGACCGAGTTCACCCTGACCATCTCCTC<br>CCTCCAACCGGAGGACTTCGCGGTGTACTACTGTCAGCAGTACAACGATTGGC<br>TGCCCGTGACATTTGGACAGGGGACGAAGGTGGAAATCAAAACCACTACCCCA<br>GCACCGAGGCCACCCACCCCGGCTCCTACCATCGCCTCCCAGCCTCTGTCCCT<br>GCGTCCGGAGGCATGTAGACCCGCAGCTGGTGGGGCCGTGCATACCCGGGGTC<br>TTGACTTCGCCTGCGATATCTACATTTGGGCCCCTCTGGCTGGTACTTGCGGG<br>GTCCTGCTGCTTTCACTCGTGATCACTCTTTACTGTAAGCGCGGTCGGAAGAA<br>GCTGCTGTACATCTTTAAGCAACCCTTCATGAGGCCTGTGCAGACTACTCAAG<br>AGGAGGACGGCTGTTCATGCCGGTTCCCAGAGGAGGAGGAAGGCGGCTGCGAA<br>CTGCGCGTGAAATTCAGCCGCAGCGCAGATGCTCCAGCCTACAAGCAGGGGCA<br>GAACCAGCTCTACAACGAACTCAATCTTGGTCGGAGAGAGGAGTACGACGTGC<br>TGGACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAAGC<br>CTATAGCGAGATTGGTATGAAAGGGGAACGCAGAAGAGGCAAAGGCCACGACG<br>GACTGTACCAGGGACTCAGCACCGCCACCAAGGACACCTATGACGCTCTTCAC<br>ATGCAGGCCCTGCCGCCTCGG |

139114

| 139114- aa<br>ScFv domain | 53 | EVQLVESGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSSASGGGGSGGRASGGGGSEIVLTQSPGTLSLSPGERATLSCRASQ<br>SIGSSSLAWYQQKPGQAPRLLMYGASSRASGIPDRFSGSGSGTDFTLTISRLE<br>PEDFAVYYCQQYAGSPPFTFGQGTKVEIK |
| 139114- nt<br>ScFv domain | 68 | GAAGTGCAATTGGTGGAATCTGGTGGAGGACTTGTGCAACCTGGAGGATCACT<br>GAGACTGTCATGCGCGGTGTCCGGTTTTGCCCTGAGCAATCATGGGATGTCGT<br>GGGTCCGGCGCGCCCCCGGAAAGGGTCTGGAATGGGTGTCGGGTATCGTCTAC<br>TCCGGGAGCACTTACTACGCCGCGAGCGTGAAGGGCCGCTTCACCATTTCCCG<br>CGATAACTCCCGCAACACCCTGTACTTGCAAATGAACTCGCTCCGGCCTGAGG<br>ACACTGCCATCTACTACTGCTCCGCACACGGAGGAGAATCCGACGTGTGGGGC<br>CAGGGAACTACCGTGACCGTCAGCAGCGCCTCCGGCGGCGGGGGCTCAGGCGG<br>ACGGGCTAGCGGCGGCGGTGGCTCCGAGATCGTGCTGACCCAGTCGCCTGGCA<br>CTCTCTCGCTGAGCCCCGGGGAAAGGGCAACCCTGTCCTGTCGGGCCAGCCAG<br>TCCATTGGATCATCCTCCCTCGCCTGGTATCAGCAGAAACCGGGACAGGCTCC<br>GCGGCTGCTTATGTATGGGCCAGCTCAAGAGCCTCCGGCATTCCCGACCGGT<br>TCTCCGGGTCCGGTTCCGGCACCGATTTCACCCTGACTATCTCGAGGCTGGAG<br>CCAGAGGACTTCGCCGTGTACTACTGCCAGCAGTACGCGGGGTCCCCGCCGTT<br>CACGTTCGGACAGGGAACCAAGGTCGAGATCAAG |
| 139114- aa<br>VH | 83 | EVQLVESGGGLVQPGGSLRLSCAVSGFALSNHGMSWVRRAPGKGLEWVSGIVY<br>SGSTYYAASVKGRFTISRDNSRNTLYLQMNSLRPEDTAIYYCSAHGGESDVWG<br>QGTTVTVSS |
| 139114- aa<br>VL | 98 | EIVLTQSPGTLSLSPGERATLSCRASQSIGSSSLAWYQQKPGQAPRLLMYGAS<br>SRASGIPDRFSGSGSGTDFTLTISRLEPEDFAVYYCQQYAGSPPFTFGQGTKV<br>EIK |
| 139114- aa<br>Full CAR | 113 | MALPVTALLLPLALLLHAARPEVQLVESGGGLVQPGGSLRLSCAVSGFALSNH<br>GMSWVRRAPGKGLEWVSGIVYSGSTYYAASVKGRFTISRDNSRNTLYLQMNSL<br>RPEDTAIYYCSAHGGESDVWGQGTTVTVSSASGGGGSGGRASGGGGSEIVLTQ<br>SPGTLSLSPGERATLSCRASQSIGSSSLAWYQQKPGQAPRLLMYGASSRASGI<br>PDRFSGSGSGTDFTLTISRLEPEDFAVYYCQQYAGSPPFTFGQGTKVEIKTTT<br>PAPRPPTPAPTIASQPLSLRPEACRPAAGGAVHTRGLDFACDIYIWAPLAGTC<br>GVLLLSLVITLYCKRGRKKLLYIFKQPFMRPVQTTQEEDGCSCRFPEEEEGGC<br>ELRVKFSRSADAPAYKQGQNQLYNELNLGRREEYDVLDKRRGRDPEMGGKPRR<br>KNPQEGLYNELQKDKMAEAYSEIGMKGERRRGKGHDGLYQGLSTATKDTYDAL<br>HMQALPPR |
| 139114- nt<br>Full CAR | 128 | ATGGCCCTCCCTGTCACCGCCCTGCTGCTTCCGCTGGCTCTTCTGCTCCACGC<br>CGCTCGGCCCGAAGTGCAATTGGTGGAATCTGGTGGAGGACTTGTGCAACCTG<br>GAGGATCACTGAGACTGTCATGCGCGGTGTCCGGTTTTGCCCTGAGCAATCAT<br>GGGATGTCGTGGGTCCGGCGCGCCCCCGGAAAGGGTCTGGAATGGGTGTCGGG<br>TATCGTCTACTCCGGGAGCACTTACTACGCCGCGAGCGTGAAGGGCCGCTTCA<br>CCATTTCCCGCGATAACTCCCGCAACACCCTGTACTTGCAAATGAACTCGCTC<br>CGGCCTGAGGACACTGCCATCTACTACTGCTCCGCACACGGAGGAGAATCCGA<br>CGTGTGGGGCCAGGGAACTACCGTGACCGTCAGCAGCGCCTCCGGCGGCGGGG<br>GCTCAGGCGGACGGGCTAGCGGCGGCGGTGGCTCCGAGATCGTGCTGACCCAG<br>TCGCCTGGCACTCTCTCGCTGAGCCCCGGGGAAAGGGCAACCCTGTCCTGTCG<br>GGCCAGCCAGTCCATTGGATCATCCTCCCTCGCCTGGTATCAGCAGAAACCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| | | GACAGGCTCCGCGGCTGCTTATGTATGGGGCCAGCTCAAGAGCCTCCGGCATT<br>CCCGACCGGTTCTCCGGGTCCGGTTCCGGCACCGATTTCACCCTGACTATCTC<br>GAGGCTGGAGCCAGAGGACTTCGCCGTGTACTACTGCCAGCAGTACGCGGGGT<br>CCCCGCCGTTCACGTTCGGACAGGGAACCAAGGTCGAGATCAAGACCACTACC<br>CCAGCACCGAGGCCACCCACCCCGGCTCCTACCATCGCCTCCCAGCCTCTGTC<br>CCTGCGTCCGGAGGCATGTAGACCCGCAGCTGGTGGGGCCGTGCATACCCGGG<br>GTCTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGGAA<br>GAAGCTGCTGTACATCTTTAAGCAACCCTTCATGAGGCCTGTGCAGACTACTC<br>AAGAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAGGG<br>GCAGAACCAGCTCTACAACGAACTCAATCTTGGTCGGAGAGAGGAGTACGACG<br>TGCTGGACAAGCGGAGAGGACGGGACCCAGAAATGGGCGGGAAGCCGCGCAGA<br>AAGAATCCCCAAGAGGGCCTGTACAACGAGCTCCAAAAGGATAAGATGGCAGA<br>AGCCTATAGCGAGATTGGTATGAAAGGGGAACGCAGAAGAGGCAAAGGCCACG<br>ACGGACTGTACCAGGGACTCAGCACCGCCACCAAGGACACCTATGACGCTCTT<br>CACATGCAGGCCCTGCCGCCTCGG |
| | | 149362 |
| 149362-aa ScFv domain | 129 | QVQLQESGPGLVKPSETLSLTCTVSGGSISSSYYYWGWIRQPPGKGLEWIGSI<br>YYSGSAYYNPSLKSRVTISVDTSKNQFSLRLSSVTAADTAVYYCARHWQEWPD<br>AFDIWGQGTMVTVSSGGGGSGGGGSGGGGSETTLTQSPAFMSATPGDKVIISC<br>KASQDIDDAMNWYQQKPGEAPLFIIQSATSPVPGIPPRFSGSGFGTDFSLTIN<br>NIESEDAAYYFCLQHDNFPLTFGQGTKLEIK |
| 149362-nt ScFv domain | 150 | CAAGTGCAGCTTCAGGAAAGCGGACCGGGCCTGGTCAAGCCATCCGAAACTCT<br>CTCCCTGACTTGCACTGTGTCTGGCGGTTCCATCTCATCGTCGTACTACTACT<br>GGGGCTGGATTAGGCAGCCGCCCGGAAAGGGACTGGAGTGGATCGGAAGCATC<br>TACTATTCCGGCTCGGCGTACTACAACCCTAGCCTCAAGTCGAGAGTGACCAT<br>CTCCGTGGATACCTCCAAGAACCAGTTTTCCCTGCGCCTGAGCTCCGTGACCG<br>CCGCTGACACCGCCGTGTACTACTGTGCTCGGCATTGGCAGGAATGGCCCGAT<br>GCCTTCGACATTTGGGGCCAGGGCACTATGGTCACTGTGTCATCCGGGGGTGG<br>AGGCAGCGGGGGAGGAGGGTCCGGGGGGGAGGTTCAGAGACAACCTTGACCC<br>AGTCACCCGCATTCATGTCCGCCACTCCGGGAGACAAGGTCATCATCTCGTGC<br>AAAGCGTCCCAGGATATCGACGATGCCATGAATTGGTACCAGCAGAAGCCTGG<br>CGAAGCGCCGCTGTTCATTATCCAATCCGCAACCTCGCCCGTGCCTGGAATCC<br>CACCGCGGTTCAGCGGCAGCGGTTTCGGAACCGACTTTTCCCTGACCATTAAC<br>AACATTGAGTCCGAGGACGCCGCCTACTACTTCTGCCTGCAACACGACAACTT<br>CCCTCTCACGTTCGGCCAGGGAACCAAGCTGGAAATCAAG |
| 149362-aa VH | 171 | QVQLQESGPGLVKPSETLSLTCTVSGGSISSSYYYWGWIRQPPGKGLEWIGSI<br>YYSGSAYYNPSLKSRVTISVDTSKNQFSLRLSSVTAADTAVYYCARHWQEWPD<br>AFDIWGQGTMVTVSS |
| 149362-aa VL | 192 | ETTLTQSPAFMSATPGDKVIISCKASQDIDDAMNWYQQKPGEAPLFIIQSATS<br>PVPGIPPRFSGSGFGTDFSLTINNIESEDAAYYFCLQHDNFPLTFGQGTKLEI<br>K |
| 149362-aa Full CAR | 213 | MALPVTALLLPLALLLHAARPQVQLQESGPGLVKPSETLSLTCTVSGGSISSS<br>YYYWGWIRQPPGKGLEWIGSIYYSGSAYYNPSLKSRVTISVDTSKNQFSLRLS<br>SVTAADTAVYYCARHWQEWPDAFDIWGQGTMVTVSSGGGGSGGGGSGGGGSET<br>TLTQSPAFMSATPGDKVIISCKASQDIDDAMNWYQQKPGEAPLFIIQSATSPV<br>PGIPPRFSGSGFGTDFSLTINNIESEDAAYYFCLQHDNFPLTFGQGTKLEIKT<br>TTPAPRPPTPAPTIASQPLSLRPEACRPAAGGAVHTRGLDFACDIYIWAPLAG<br>TCGVLLLSLVITLYCKRGRKKLLYIFKQPFMRPVQTTQEEDGCSCRFPEEEEG<br>GCELRVKFSRSADAPAYKQGQNQLYNELNLGRREEYDVLDKRRGRDPEMGGKP<br>RRKNPQEGLYNELQKDKMAEAYSEIGMKGERRRGKGHDGLYQGLSTATKDTYD<br>ALHMQALPPR |
| 149362-nt Full CAR | 234 | ATGGCCCTCCCTGTCACCGCCCTGCTGCTTCCGCTGGCTCTTCTGCTCCACGC<br>CGCTCGGCCCCAAGTGCAGCTTCAGGAAAGCGGACCGGGCCTGGTCAAGCCAT<br>CCGAAACTCTCTCCCTGACTTGCACTGTGTCTGGCGGTTCCATCTCATCGTCG<br>TACTACTACTGGGGCTGGATTAGGCAGCCGCCCGGAAAGGGACTGGAGTGGAT<br>CGGAAGCATCTACTATTCCGGCTCGGCGTACTACAACCCTAGCCTCAAGTCGA<br>GAGTGACCATCTCCGTGGATACCTCCAAGAACCAGTTTTCCCTGCGCCTGAGC<br>TCCGTGACCGCCGCTGACACCGCCGTGTACTACTGTGCTCGGCATTGGCAGGA<br>ATGGCCCGATGCCTTCGACATTTGGGGCCAGGGCACTATGGTCACTGTGTCAT<br>CCGGGGGTGGAGGCAGCGGGGGAGGAGGGTCCGGGGGGGAGGTTCAGAGACA<br>ACCTTGACCCAGTCACCCGCATTCATGTCCGCCACTCCGGGAGACAAGGTCAT<br>CATCTCGTGCAAAGCGTCCCAGGATATCGACGATGCCATGAATTGGTACCAGC<br>AGAAGCCTGGCGAAGCGCCGCTGTTCATTATCCAATCCGCAACCTCGCCCGTG<br>CCTGGAATCCCACCGCGGTTCAGCGGCAGCGGTTTCGGAACCGACTTTTCCCT<br>GACCATTAACAACATTGAGTCCGAGGACGCCGCCTACTACTTCTGCCTGCAAC<br>ACGACAACTTCCCTCTCACGTTCGGCCAGGGAACCAAGCTGGAAATCAAGACC |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | ACTACCCCAGCACCGAGGCCACCCACCCCGGCTCCTACCATCGCCTCCCAGCC<br>TCTGTCCCTGCGTCCGGAGGCATGTAGACCCGCAGCTGGTGGGGCCGTGCATA<br>CCCGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGCGG<br>TCGGAAGAAGCTGCTGTACATCTTTAAGCAACCCTTCATGAGGCCTGTGCAGA<br>CTACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTACAA<br>GCAGGGGCAGAACCAGCTCTACAACGAACTCAATCTTGGTCGGAGAGAGGAGT<br>ACGACGTGCTGGACAAGCGGAGAGGACGGGACCCAGAAATGGGCGGGAAGCCG<br>CGCAGAAAGAATCCCCAAGAGGGCCTGTACAACGAGCTCCAAAAGGATAAGAT<br>GGCAGAAGCCTATAGCGAGATTGGTATGAAAGGGAACGCAGAAGAGGCAAAG<br>GCCACGACGGACTGTACCAGGGACTCAGCACCGCCACCAAGGACACCTATGAC<br>GCTCTTCACATGCAGGCCCTGCCGCCCTCGG |
| | | 149363 |
| 149363-aa<br>ScFv domain | 130 | VNLRESGPALVKPTQTLTLTCTFSGFSLRTSGMCVSWIRQPPGKALEWLARID<br>WDEDKFYSTSLKTRLTISKDTSDNQVVLRMTNMDPADTATYYCARSGAGGTSA<br>TAFDIWGPGTMVTVSSGGGGSGGGGSGGGGSDIQMTQSPSSLSASVGDRVTIT<br>CRASQDIYNNLAWFQLKPGSAPRSLMYAANKSQSGVPSRFSGSASGTDFTLTI<br>SSLQPEDFATYYCQHYYRFPYSFGQGTKLEIK |
| 149363-nt<br>ScFv domain | 151 | CAAGTCAATCTGCGCGAATCCGGCCCCGCCTTGGTCAAGCCTACCCAGACCCT<br>CACTCTGACCTGTACTTTCTCCGGCTTCTCCCTGCGGACTTCCGGGATGTGCG<br>TGTCCTGGATCAGACAGCCTCCGGGAAAGGCCCTGGAGTGGCTCGCTCGCATT<br>GACTGGGATGAGGACAAGTTCTACTCCACCTCACTCAAGACCAGGCTGACCAT<br>CAGCAAAGATACCTCTGACAACCAAGTGGTGCTCCGCATGACCAACATGGACC<br>CAGCCGACACTGCCACTTACTACTGCGCGAGGAGCGGAGCGGGCGGAACCTCC<br>GCCACCGCCTTCGATATTTGGGGCCCGGGTACCATGGTCACCGTGTCAAGCGG<br>AGGAGGGGGGTCCGGGGGCGGCGGTTCCGGGGGAGGCGGATCGGACATTCAGA<br>TGACTCAGTCACCATCGTCCCTGAGCGCTAGCGTGGGCGACAGAGTGACAATC<br>ACTTGCCGGGCATCCCAGGACATCTATAACAACCTTGCGTGGTTCCAGCTGAA<br>GCCTGGTTCCGCACCGCGGTCACTTATGTACGCCGCCAACAAGAGCCAGTCGG<br>GAGTGCCCGTCCCGGTTTTCCGGTTCGGCCTCGGGAACTGACTTCACCCTGACG<br>ATCTCCAGCCTGCAACCCGAGGATTTCGCCACCTACTACTGCCAGCACTACTA<br>CCGCTTTCCCTACTCGTTCGGACAGGGAACCAAGCTGGAAATCAAG |
| 149363-aa<br>VH | 172 | QVNLRESGPALVKPTQTLTLTCTFSGFSLRTSGMCVSWIRQPPGKALEWLARI<br>DWDEDKFYSTSLKTRLTISKDTSDNQVVLRMTNMDPADTATYYCARSGAGGTS<br>ATAFDIWGPGTMVTVSS |
| 149363-aa VL | 193 | DIQMTQSPSSLSASVGDRVTITCRASQDIYNNLAWFQLKPGSAPRSLMYAANK<br>SQSGVPSRFSGSASGTDFTLTISSLQPEDFATYYCQHYYRFPYSFGQGTKLEI<br>K |
| 149363-aa<br>Full CAR | 214 | MALPVTALLLPLALLLHAARPQVNLRESGPALVKPTQTLTLTCTFSGFSLRTS<br>GMCVSWIRQPPGKALEWLARIDWDEDKFYSTSLKTRLTISKDTSDNQVVLRMT<br>NMDPADTATYYCARSGAGGTSATAFDIWGPGTMVTVSSGGGGSGGGGSGGGGS<br>DIQMTQSPSSLSASVGDRVTITCRASQDIYNNLAWFQLKPGSAPRSLMYAANK<br>SQSGVPSRFSGSASGTDFTLTISSLQPEDFATYYCQHYYRFPYSFGQGTKLEI<br>KTTTPAPRPPTPAPTIASQPLSLRPEACRPAAGGAVHTRGLDFACDIYIWAPL<br>AGTCGVLLLSLVITLYCKRGRKKLLYIFKQPFMRPVQTTQEEDGCSCRFPEEE<br>EGGCELRVKFSRSADAPAYKQGQNQLYNELNLGRREEYDVLDKRRGRDPEMGG<br>KPRRKNPQEGLYNELQKDKMAEAYSEIGMKGERRRGKGHDGLYQGLSTATKDT<br>YDALHMQALPPR |
| 149363-nt<br>Full CAR | 235 | ATGGCCCTCCCTGTCACCGCCCTGCTGCTTCCGCTGGCTCTTCTGCTCCACGC<br>CGCTCGGCCCCAAGTCAATCTGCGCGAATCCGGCCCCGCCTTGGTCAAGCCTA<br>CCCAGACCCTCACTCTGACCTGTACTTTCTCCGGCTTCTCCCTGCGGACTTCC<br>GGGATGTGCGTGTCCTGGATCAGACAGCCTCCGGGAAAGGCCCTGGAGTGGCT<br>CGCTCGCATTGACTGGGATGAGGACAAGTTCTACTCCACCTCACTCAAGACCA<br>GGCTGACCATCAGCAAAGATACCTCTGACAACCAAGTGGTGCTCCGCATGACC<br>AACATGGACCCAGCCGACACTGCCACTTACTACTGCGCGAGGAGCGGAGCGGG<br>CGGAACCTCCGCCACCGCCTTCGATATTTGGGGCCCGGGTACCATGGTCACCG<br>TGTCAAGCGGAGGAGGGGGGTCCGGGGGCGGCGGTTCCGGGGGAGGCGGATCG<br>GACATTCAGATGACTCAGTCACCATCGTCCCTGAGCGCTAGCGTGGGCGACAG<br>AGTGACAATCACTTGCCGGGCATCCCAGGACATCTATAACAACCTTGCGTGGT<br>TCCAGCTGAAGCCTGGTTCCGCACCGCGGTCACTTATGTACGCCGCCAACAAG<br>AGCCAGTCGGGAGTGCCCGTCCCGGTTTTCCGGTTCGGCCTCGGGAACTGACTT<br>CACCCTGACGATCTCCAGCCTGCAACCCGAGGATTTCGCCACCTACTACTGCC<br>AGCACTACTACCGCTTTCCCTACTCGTTCGGACAGGGAACCAAGCTGGAAATC<br>AAGACCACTACCCCAGCACCGAGGCCACCCACCCCGGCTCCTACCATCGCCTC<br>CCAGCCTCTGTCCCTGCGTCCGGAGGCATGTAGACCCGCAGCTGGTGGGGCCG<br>TGCATACCCGGGGTCTTGACTTCGCCTGCGATATCTACATTTGGGCCCCTCTG<br>GCTGGTACTTGCGGGGTCCTGCTGCTTTCACTCGTGATCACTCTTTACTGTAA |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| | | GCGCGGTCGGAAGAAGCTGCTGTACATCTTTAAGCAACCCTTCATGAGGCCTG<br>TGCAGACTACTCAAGAGGAGGACGGCTGTTCATGCCGGTTCCCAGAGGAGGAG<br>GAAGGCGGCTGCGAACTGCGCGTGAAATTCAGCCGCAGCGCAGATGCTCCAGC<br>CTACAAGCAGGGGCAGAACCAGCTCTACAACGAACTCAATCTTGGTCGGAGAG<br>AGGAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAGGA<br>TAAGATGGCAGAAGCCTATAGCGAGATTGGTATGAAAGGGGAACGCAGAAGAG<br>GCAAAGGCCACGACGGACTGTACCAGGGACTCAGCACCGCCACCAAGGACACC<br>TATGACGCTCTTCACATGCAGGCCCTGCCGCCTCGG |

149364

| 149364-aa<br>ScFv domain | 131 | EVQLVESGGGLVKPGGSLRLSCAASGFTFSSYSMNWVRQAPGKGLEWVSSISS<br>SSSYIYYADSVKGRFTISRDNAKNSLYLQMNSLRAEDTAVYYCAKTIAAVYAF<br>DIWGQGTTVTVSSGGGGSGGGGSGGGGSEIVLTQSPLSLPVTPEEPASISCRS<br>SQSLLHSNGYNYLDWYLQKPGQSPQLLIYLGSNRASGVPDRFSGSGSGTDFTL<br>KISRVEAEDVGVYYCMQALQTPYTFGQGTKLEIK |
| 149364-nt<br>ScFv domain | 152 | GAAGTGCAGCTTGTCGAATCCGGGGGGGGACTGGTCAAGCCGGGCGGATCACT<br>GAGACTGTCCTGCGCCGCGAGCGGCTTCACGTTCTCCTCCTACTCCATGAACT<br>GGGTCCGCCAAGCCCCCGGGAAGGGACTGGAATGGGTGTCCTCTATCTCCTCG<br>TCGTCGTCCTACATCTACTACGCCGACTCCGTGAAGGGAAGATTCACCATTTC<br>CCGCGACAACGCAAAGAACTCACTGTACTTGCAAATGAACTCACTCCGGGCCG<br>AAGATACTGCTGTGTACTATTGCGCCAAGACTATTGCCGCCGTCTACGCTTTC<br>GACATCTGGGGCCAGGGAACCACCGTGACTGTGTCGTCCGGTGGTGGTGGCTC<br>GGGCGGAGGAGGAAGCGGCGGCGGGGGGTCCGAGATTGTGCTGACCCAGTCGC<br>CACTGAGCCTCCCTGTGACCCCCGAGGAACCCGCCAGCATCAGCTGCCGGTCC<br>AGCCAGTCCCTGCTCCACTCCAACGGATACAATTACCTCGATTGGTACCTTCA<br>GAAGCCTGGACAAAGCCCGCAGCTGCTCATCTACTTGGGATCAAACCGCGCGT<br>CAGGAGTGCCTGACCGGTTCTCCGGCTCGGGCAGCGGTACCGATTTCACCCTG<br>AAAATCTCCAGGGTGGAGGCAGAGGACGTGGGAGTGTATTACTGTATGCAGGC<br>GCTGCAGACTCCGTACACATTTGGGCAGGGCACCAAGCTGGAGATCAAG |
| 149364-aa<br>VH | 173 | EVQLVESGGGLVKPGGSLRLSCAASGFTFSSYSMNWVRQAPGKGLEWVSSISS<br>SSSYIYYADSVKGRFTISRDNAKNSLYLQMNSLRAEDTAVYYCAKTIAAVYAF<br>DIWGQGTTVTVSS |
| 149364-aa VL | 194 | EIVLTQSPLSLPVTPEEPASISCRSSQSLLHSNGYNYLDWYLQKPGQSPQLLI<br>YLGSNRASGVPDRFSGSGSGTDFTLKISRVEAEDVGVYYCMQALQTPYTFGQG<br>TKLEIK |
| 149364-aa<br>Full CAR | 215 | MALPVTALLLPLALLLHAARPEVQLVESGGGLVKPGGSLRLSCAASGFTFSSY<br>SMNWVRQAPGKGLEWVSSISSSSSYIYYADSVKGRFTISRDNAKNSLYLQMNS<br>LRAEDTAVYYCAKTIAAVYAFDIWGQGTTVTVSSGGGGSGGGGSGGGGSEIVL<br>TQSPLSLPVTPEEPASISCRSSQSLLHSNGYNYLDWYLQKPGQSPQLLIYLGS<br>NRASGVPDRFSGSGSGTDFTLKISRVEAEDVGVYYCMQALQTPYTFGQGTKLE<br>IKTTTPAPRPPTPAPTIASQPLSLRPEACRPAAGGAVHTRGLDFACDIYIWAP<br>LAGTCGVLLLSLVITLYCKRGRKKLLYIFKQPFMRPVQTTQEEDGCSCRFPEE<br>EEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKD<br>TYDALHMQALPPR |
| 149364-nt<br>Full CAR | 236 | ATGGCCCTCCCTGTCACCGCCCTGCTGCTTCCGCTGGCTCTTCTGCTCCACGC<br>CGCTCGGCCCGAAGTGCAGCTTGTCGAATCCGGGGGGGGACTGGTCAAGCCGG<br>GCGGATCACTGAGACTGTCCTGCGCCGCGAGCGGCTTCACGTTCTCCTCCTAC<br>TCCATGAACTGGGTCCGCCAAGCCCCCGGGAAGGGACTGGAATGGGTGTCCTC<br>TATCTCCTCGTCGTCGTCCTACATCTACTACGCCGACTCCGTGAAGGGAAGAT<br>TCACCATTTCCCGCGACAACGCAAAGAACTCACTGTACTTGCAAATGAACTCA<br>CTCCGGGCCGAAGATACTGCTGTGTACTATTGCGCCAAGACTATTGCCGCCGT<br>CTACGCTTTCGACATCTGGGGCCAGGGAACCACCGTGACTGTGTCGTCCGGTG<br>GTGGTGGCTCGGGCGGAGGAGGAAGCGGCGGCGGGGGGTCCGAGATTGTGCTG<br>ACCCAGTCGCCACTGAGCCTCCCTGTGACCCCCGAGGAACCCGCCAGCATCAG<br>CTGCCGGTCCAGCCAGTCCCTGCTCCACTCCAACGGATACAATTACCTCGATT<br>GGTACCTTCAGAAGCCTGGACAAAGCCCGCAGCTGCTCATCTACTTGGGATCA<br>AACCGCGCGTCAGGAGTGCCTGACCGGTTCTCCGGCTCGGGCAGCGGTACCGA<br>TTTCACCCTGAAAATCTCCAGGGTGGAGGCAGAGGACGTGGGAGTGTATTACT<br>GTATGCAGGCGCTGCAGACTCCGTACACATTTGGGCAGGGCACCAAGCTGGAG<br>ATCAAGACCACTACCCCAGCACCGAGGCCACCCACCCCGGCTCCTACCATCGC<br>CTCCCAGCCTCTGTCCCTGCGTCCGGAGGCATGTAGACCCGCAGCTGGTGGGG<br>CCGTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTACTG<br>TAAGCGCGGTCGGAAGAAGCTGCTGTACATCTTTAAGCAACCCTTCATGAGGC<br>CTGTGCAGACTACTCAAGAGGAGGACGGCTGTTCATGCCGGTTCCCAGAGGAG<br>GAGGAAGGCGGCTGCGAACTGCGCGTGAAATTCAGCCGCAGCGCAGATGCTCC<br>AGCCTACAAGCAGGGGCAGAACCAGCTCTACAACGAACTCAATCTTGGTCGGA |

TABLE 8-continued

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/ Description | SEQ ID NO: | Sequence |
|---|---|---|
| | | GAGAGGAGTACGACGTGCTGGACAAGCGGAGAGGACGGGACCCAGAAATGGGC<br>GGGAAGCCGCGCAGAAAGAATCCCCAAGAGGGCCTGTACAACGAGCTCCAAAA<br>GGATAAGATGGCAGAAGCCTATAGCGAGATTGGTATGAAAGGGGAACGCAGAA<br>GAGGCAAAGGCCACGACGGACTGTACCAGGGACTCAGCACCGCCACCAAGGAC<br>ACCTATGACGCTCTTCACATGCAGGCCCTGCCGCCTCGG |
| | | 149365 |
| 149365-aa ScFv domain | 132 | EVQLVESGGGLVKPGGSLRLSCAASGFTFSDYYMSWIRQAPGKGLEWVSYISS<br>SGSTIYYADSVKGRFTISRDNAKNSLYLQMNSLRAEDTAVYYCARDLRGAFDI<br>WGQGTMVTVSSGGGGSGGGGSGGGGSSYVLTQSPSVSAAPGYTATISCGGNNI<br>GTKSVHWYQQKPGQAPLLVIRDDSVRPSKIPGRFSGSNSGNMATLTISGVQAG<br>DEADFYCQVWDSDSEHVVFGGGTKLTVL |
| 149365-nt ScFv domain | 153 | GAAGTCCAGCTCGTGGAGTCCGGCGGAGGCCTTGTGAAGCCTGGAGGTTCGCT<br>GAGACTGTCCTGCGCCGCCTCCGGCTTCACCTTCTCCGACTACTACATGTCCT<br>GGATCAGACAGGCCCCGGGAAAGGGCCTGGAATGGGTGTCCTACATCTCGTCA<br>TCGGGCAGCACTATCTACTACGCGGACTCAGTGAAGGGGCGGTTCACCATTTC<br>CCGGGATAACGCGAAGAACTCGCTGTATCTGCAAATGAACTCACTGAGGGCCG<br>AGGACACCGCCGTGTACTACTGCGCCCGCGATCTCCGCGGGGCATTTGACATC<br>TGGGGACAGGGAACCATGGTCACAGTGTCCAGCGGAGGGGGAGGATCGGGTGG<br>CGGAGGTTCCGGGGGTGGAGGCTCCTCCTACGTGCTGACTCAGAGCCCAAGCG<br>TCAGCGCTGCGCCCGGTTACACGGCAACCATCTCCTGTGGCGGAAACAACATT<br>GGGACCAAGTCTGTGCACTGGTATCAGCAGAAGCCGGGCCAAGCTCCCCTGTT<br>GGTGATCCGCGATGACTCCGTGCGGCCTAGCAAAATTCCGGGACGGTTCTCCG<br>GCTCCAACAGCGGCAATATGGCCACTCTCACCATCTCGGGAGTGCAGGCCGGA<br>GATGAAGCCGACTTCTACTGCCAAGTCTGGGACTCAGACTCCGAGCATGTGGT<br>GTTCGGGGGCGGAACCAAGCTGACTGTGCTC |
| 149365-aa VH | 174 | EVQLVESGGGLVKPGGSLRLSCAASGFTFSDYYMSWIRQAPGKGLEWVSYISS<br>SGSTIYYADSVKGRFTISRDNAKNSLYLQMNSLRAEDTAVYYCARDLRGAFDI<br>WGQGTMVTVSS |
| 149365-aa VL | 195 | SYVLTQSPSVSAAPGYTATISCGGNNIGTKSVHWYQQKPGQAPLLVIRDDSVR<br>PSKIPGRFSGSNSGNMATLTISGVQAGDEADFYCQVWDSDSEHVVFGGGTKLT<br>VL |
| 149365-aa Full CAR | 216 | MALPVTALLLPLALLLHAARPEVQLVESGGGLVKPGGSLRLSCAASGFTFSDY<br>YMSWIRQAPGKGLEWVSYISSSGSTIYYADSVKGRFTISRDNAKNSLYLQMNS<br>LRAEDTAVYYCARDLRGAFDIWGQGTMVTVSSGGGGSGGGGSGGGGSSYVLTQ<br>SPSVSAAPGYTATISCGGNNIGTKSVHWYQQKPGQAPLLVIRDDSVRPSKIPG<br>RFSGSNSGNMATLTISGVQAGDEADFYCQVWDSDSEHVVFGGGTKLTVLTTTP<br>APRPPTPAPTIASQPLSLRPEACRPAAGGAVHTRGLDFACDIYIWAPLAGTCG<br>VLLLSLVITLYCKRGRKKLLYIFKQPFMRPVQTTQEEDGCSCRFPEEEEGGCE<br>LRVKFSRSADAPAYKQGQNQLYNELNLGRREEYDVLDKRRGRDPEMGGKPRRK<br>NPQEGLYNELQKDKMAEAYSEIGMKGERRRGKGHDGLYQGLSTATKDTYDALH<br>MQALPPR |
| 149365-nt Full CAR | 237 | ATGGCCCTCCCTGTCACCGCCCTGCTGCTTCCGCTGGCTCTTCTGCTCCACGC<br>CGCTCGGCCCGAAGTCCAGCTCGTGGAGTCCGGCGGAGGCCTTGTGAAGCCTG<br>GAGGTTCGCTGAGACTGTCCTGCGCCGCCTCCGGCTTCACCTTCTCCGACTAC<br>TACATGTCCTGGATCAGACAGGCCCCGGGAAAGGGCCTGGAATGGGTGTCCTA<br>CATCTCGTCATCGGGCAGCACTATCTACTACGCGGACTCAGTGAAGGGGCGGT<br>TCACCATTTCCCGGGATAACGCGAAGAACTCGCTGTATCTGCAAATGAACTCA<br>CTGAGGGCCGAGGACACCGCCGTGTACTACTGCGCCCGCGATCTCCGCGGGGC<br>ATTTGACATCTGGGGACAGGGAACCATGGTCACAGTGTCCAGCGGAGGGGGAG<br>GATCGGGTGGCGGAGGTTCCGGGGGTGGAGGCTCCTCCTACGTGCTGACTCAG<br>AGCCCAAGCGTCAGCGCTGCGCCCGGTTACACGGCAACCATCTCCTGTGGCGG<br>AAACAACATTGGGACCAAGTCTGTGCACTGGTATCAGCAGAAGCCGGGCCAAG<br>CTCCCCTGTTGGTGATCCGCGATGACTCCGTGCGGCCTAGCAAAATTCCGGGA<br>CGGTTCTCCGGCTCCAACAGCGGCAATATGGCCACTCTCACCATCTCGGGAGT<br>GCAGGCCGGAGATGAAGCCGACTTCTACTGCCAAGTCTGGGACTCAGACTCCG<br>AGCATGTGGTGTTCGGGGGCGGAACCAAGCTGACTGTGCTCACCACTACCCCA<br>GCACCGAGGCCACCCACCCCGGCTCCTACCATCGCCTCCCAGCCTCTGTCCCT<br>GCGTCCGGAGGCATGTAGACCCGCAGCTGGTGGGGCCGTGCATACCCGGGGTC<br>TTGACTTCGCCTGCGATATCTACATTTGGGCCCCTCTGGCTGGTACTTGCGGG<br>GTCCTGCTGCTTTCACTCGTGATCACTCTTTACTGTAAGCGCGGTCGGAAGAA<br>GCTGCTGTACATCTTTAAGCAACCCTTCATGAGGCCTGTGCAGACTACTCAAG<br>AGGAGGACGGCTGTTCATGCCGGTTCCCAGAGGAGGAGGAAGGCGGCTGCGAA<br>CTGCGCGTGAAATTCAGCCGCAGCGCAGATGCTCCAGCCTACAAGCAGGGGCA<br>GAACCAGCTCTACAACGAACTCAATCTTGGTCGGAGAGAGGAGTACGACGTGC |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | TGGACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAAGC<br>CTATAGCGAGATTGGTATGAAAGGGGAACGCAGAAGAGGCAAAGGCCACGACG<br>GACTGTACCAGGGACTCAGCACCGCCACCAAGGACACCTATGACGCTCTTCAC<br>ATGCAGGCCCTGCCGCCTCGG |
| | | 149366 |
| 149366-aa<br>ScFv domain | 133 | QVQLVQSGAEVKKPGASVKVSCKPSGYTVTSHYIHWVRRAPGQGLEWMGMINP<br>SGGVTAYSQTLQGRVTMTSDTSSSTVYMELSSLRSEDTAMYYCAREGSGSGWY<br>FDFWGRGTLVTVSSGGGGSGGGGSGGGGSSYVLTQPPSVSVSPGQTASITCSG<br>DGLSKKYVSWYQQKAGQSPVVLISRDKERPSGIPDRFSGSNSADTATLTISGT<br>QAMDEADYYCQAWDDTTVVFGGGTKLTVL |
| 149366-nt<br>ScFv domain | 154 | CAAGTGCAGCTGGTGCAGAGCGGGGCCGAAGTCAAGAAGCCGGGAGCCTCCGT<br>GAAAGTGTCCTGCAAGCCTTCGGGATACACCGTGACCTCCCACTACATTCATT<br>GGGTCCGCCGCGCCCCCGGCCAAGGACTCGAGTGGATGGGCATGATCAACCCT<br>AGCGGCGGAGTGACCGCGTACAGCCAGACGCTGCAGGGACGCGTGACTATGAC<br>CTCGGATACCTCCTCCTCCACCGTCTATATGGAACTGTCCAGCCTGCGGTCCG<br>AGGATACCGCCATGTACTACTGCGCCCGGGAAGGATCAGGCTCCGGGTGGTAT<br>TTCGACTTCTGGGGAAGAGGCACCCTCGTGACTGTGTCATCTGGGGGAGGGGG<br>TTCCGGTGGTGGCGGATCGGGAGGAGGCGGTTCATCCTACGTGCTGACCCAGC<br>CACCCTCCGTGTCCGTGAGCCCCGGCCAGACTGCATCGATTACATGTAGCGGC<br>GACGGCCTCTCCAAGAAATACGTGTCGTGGTACCAGCAGAAGGCCGGACAGAG<br>CCCGGTGGTGCTGATCTCAAGAGATAAGGAGCGGCCTAGCGGAATCCCGGACA<br>GGTTCTCGGGTTCCAACTCCGCGGACACTGCTACTCTGACCATCTCGGGGACC<br>CAGGCTATGGACGAAGCCGATTACTACTGCCAAGCCTGGGACGACACTACTGT<br>CGTGTTTGGAGGGGGCACCAAGTTGACCGTCCTT |
| 149366-aa<br>VH | 175 | QVQLVQSGAEVKKPGASVKVSCKPSGYTVTSHYIHWVRRAPGQGLEWMGMINP<br>SGGVTAYSQTLQGRVTMTSDTSSSTVYMELSSLRSEDTAMYYCAREGSGSGWY<br>FDFWGRGTLVTVSS |
| 149366-aa VL | 196 | SYVLTQPPSVSVSPGQTASITCSGDGLSKKYVSWYQQKAGQSPVVLISRDKER<br>PSGIPDRFSGSNSADTATLTISGTQAMDEADYYCQAWDDTTVVFGGGTKLTVL |
| 149366-aa<br>Full CAR | 217 | MALPVTALLLPLALLLHAARPQVQLVQSGAEVKKPGASVKVSCKPSGYTVTSH<br>YIHWVRRAPGQGLEWMGMINPSGGVTAYSQTLQGRVTMTSDTSSSTVYMELSS<br>LRSEDTAMYYCAREGSGSGWYFDFWGRGTLVTVSSGGGGSGGGGSGGGGSSYV<br>LTQPPSVSVSPGQTASITCSGDGLSKKYVSWYQQKAGQSPVVLISRDKERPSG<br>IPDRFSGSNSADTATLTISGTQAMDEADYYCQAWDDTTVVFGGGTKLTVLTTT<br>PAPRPPTPAPTIASQPLSLRPEACRPAAGGAVHTRGLDFACDIYIWAPLAGTC<br>GVLLLSLVITLYCKRGRKKLLYIFKQPFMRPVQTTQEEDGCSCRFPEEEEGGC<br>ELRVKFSRSADAPAYKQGQNQLYNELNLGRREEYDVLDKRRGRDPEMGGKPRR<br>KNPQEGLYNELQKDKMAEAYSEIGMKGERRRGKGHDGLYQGLSTATKDTYDAL<br>HMQALPPR |
| 149366-nt<br>Full CAR | 238 | ATGGCCCTCCCTGTCACCGCCCTGCTGCTTCCGCTGGCTCTTCTGCTCCACGC<br>CGCTCGGCCCCAAGTGCAGCTGGTGCAGAGCGGGGCCGAAGTCAAGAAGCCGG<br>GAGCCTCCGTGAAAGTGTCCTGCAAGCCTTCGGGATACACCGTGACCTCCCAC<br>TACATTCATTGGGTCCGCCGCGCCCCCGGCCAAGGACTCGAGTGGATGGGCAT<br>GATCAACCCTAGCGGCGGAGTGACCGCGTACAGCCAGACGCTGCAGGGACGCG<br>TGACTATGACCTCGGATACCTCCTCCTCCACCGTCTATATGGAACTGTCCAGC<br>CTGCGGTCCGAGGATACCGCCATGTACTACTGCGCCCGGGAAGGATCAGGCTC<br>CGGGTGGTATTTCGACTTCTGGGGAAGAGGCACCCTCGTGACTGTGTCATCTG<br>GGGGAGGGGGTTCCGGTGGTGGCGGATCGGGAGGAGGCGGTTCATCCTACGTG<br>CTGACCCAGCCACCCTCCGTGTCCGTGAGCCCCGGCCAGACTGCATCGATTAC<br>ATGTAGCGGCGACGGCCTCTCCAAGAAATACGTGTCGTGGTACCAGCAGAAGG<br>CCGGACAGAGCCCGGTGGTGCTGATCTCAAGAGATAAGGAGCGGCCTAGCGGA<br>ATCCCGGACAGGTTCTCGGGTTCCAACTCCGCGGACACTGCTACTCTGACCAT<br>CTCGGGGACCCAGGCTATGGACGAAGCCGATTACTACTGCCAAGCCTGGGACG<br>ACACTACTGTCGTGTTTGGAGGGGGCACCAAGTTGACCGTCCTTACCACTACC<br>CCAGCACCGAGGCCACCCACCCCGGCTCCTACCATCGCCTCCCAGCCTCTGTC<br>CCTGCGTCCGGAGGCATGTAGACCCGCAGCTGGTGGGCCGTGCATACCCGGG<br>GTCTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGGAA<br>GAAGCTGCTGTACATCTTTAAGCAACCCTTCATGAGGCCTGTGCAGACTACTC<br>AAGAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAGGG<br>GCAGAACCAGCTCTACAACGAACTCAATCTTGGTCGGAGAGAGGAGTACGACG<br>TGCTGGACAAGCGGAGAGGACGGGACCCAGAAATGGGCGGGAAGCCGCGCAGA<br>AAGAATCCCCAAGAGGGCCTGTACAACGAGCTCCAAAAGGATAAGATGGCAGA<br>AGCCTATAGCGAGATTGGTATGAAAGGGGAACGCAGAAGAGGCAAAGGCCACG<br>ACGGACTGTACCAGGGACTCAGCACCGCCACCAAGGACACCTATGACGCTCTT<br>CACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| | | 149367 |
| 149367-aa ScFv domain | 134 | QVQLQESGPGLVKPSQTLSLTCTVSGGSISSGGYYWSWIRQHPGKGLEWIGYI YYSGSTYYNPSLKSRVTISVDTSKNQFSLKLSSVTAADTAVYYCARAGIAARL RGAFDIWGQGTMVTVSSGGGGSGGGGSGGGGSDIVMTQSPSSVSASVGDRVII TCRASQGIRNWLAWYQQKPGKAPNLLIYAASNLQSGVPSRFSGSGSGADFTLT ISSLQPEDVATYYCQKYNSAPFTFGPGTKVDIK |
| 149367-nt ScFv domain | 155 | CAAGTGCAGCTTCAGGAGAGCGGCCCGGGACTCGTGAAGCCGTCCCAGACCCT GTCCCTGACTTGCACCGTGTCGGGAGGAAGCATCTCGAGCGGAGGCTACTATT GGTCGTGGATTCGGCAGCACCCTGGAAAGGGCCTGGAATGGATCGGCTACATC TACTACTCCGGCTCGACCTACTACAACCCATCGCTGAAGTCCAGAGTGACAAT CTCAGTGGACACGTCCAAGAATCAGTTCAGCCTGAAGCTCTCTTCCGTGACTG CGGCCGACACCGCCGTGTACTACTGCGCACGCGCTGGAATTGCCGCCCGGCTG AGGGGTGCCTTCGACATTTGGGGACAGGGCACCATGGTCACCGTGTCCTCCGG CGGCGGAGGTTCCGGGGGTGGAGGCTCAGGAGGAGGGGGGTCCGACATCGTCA TGACTCAGTCGCCCTCAAGCGTCAGCGCGTCCGTCGGGGACAGAGTGATCATC ACCTGTCGGGCGTCCCAGGGAATTCGCAACTGGCTGGCCTGGTATCAGCAGAA GCCCGGAAAGGCCCCCAACCTGTTGATCTACGCCGCCTCAAACCTCCAATCCG GGGTGCCGAGCCGCTTCAGCGGCTCCGGTTCGGGTGCCGATTTCACTCTGACC ATCTCCTCCCTGCAACCTGAAGATGTGGCTACCTACTACTGCCAAAAGTACAA CTCCGCACCTTTTACTTTCGGACCGGGGACCAAAGTGGACATTAAG |
| 149367-aa VH | 176 | QVQLQESGPGLVKPSQTLSLTCTVSGGSISSGGYYWSWIRQHPGKGLEWIGYI YYSGSTYYNPSLKSRVTISVDTSKNQFSLKLSSVTAADTAVYYCARAGIAARL RGAFDIWGQGTMVTVSS |
| 149367-aa VL | 197 | DIVMTQSPSSVSASVGDRVIITCRASQGIRNWLAWYQQKPGKAPNLLIYAASN LQSGVPSRFSGSGSGADFTLTISSLQPEDVATYYCQKYNSAPFTFGPGTKVDI K |
| 149367-aa Full CAR | 218 | MALPVTALLLPLALLLHAARPQVQLQESGPGLVKPSQTLSLTCTVSGGSISSG GYYWSWIRQHPGKGLEWIGYIYYSGSTYYNPSLKSRVTISVDTSKNQFSLKLS SVTAADTAVYYCARAGIAARLRGAFDIWGQGTMVTVSSGGGGSGGGGSGGGGS DIVMTQSPSSVSASVGDRVIITCRASQGIRNWLAWYQQKPGKAPNLLIYAASN LQSGVPSRFSGSGSGADFTLTISSLQPEDVATYYCQKYNSAPFTFGPGTKVDI KTTTPAPRPPTPAPTIASQPLSLRPEACRPAAGGAVHTRGLDFACDIYIWAPL AGTCGVLLLSLVITLYCKRGRKKLLYIFKQPFMRPVQTTQEEDGCSCRFPEEE EGGCELRVKFSRSADAPAYKQGQNQLYNELNLGRREEYDVLDKRRGRDPEMGG KPRRKNPQEGLYNELQKDKMAEAYSEIGMKGERRRGKGHDGLYQGLSTATKDT YDALHMQALPPR |
| 149367-nt Full CAR | 239 | ATGGCCCTCCCTGTCACCGCCCTGCTGCTTCCGCTGGCTCTTCTGCTCCACGC CGCTCGGCCCCAAGTGCAGCTTCAGGAGAGCGGCCCGGGACTCGTGAAGCCGT CCCAGACCCTGTCCCTGACTTGCACCGTGTCGGGAGGAAGCATCTCGAGCGGA GGCTACTATTGGTCGTGGATTCGGCAGCACCCTGGAAAGGGCCTGGAATGGAT CGGCTACATCTACTACTCCGGCTCGACCTACTACAACCCATCGCTGAAGTCCA GAGTGACAATCTCAGTGGACACGTCCAAGAATCAGTTCAGCCTGAAGCTCTCT TCCGTGACTGCGGCCGACACCGCCGTGTACTACTGCGCACGCGCTGGAATTGC CGCCCGGCTGAGGGGTGCCTTCGACATTTGGGGACAGGGCACCATGGTCACCG TGTCCTCCGGCGGCGGAGGTTCCGGGGGTGGAGGCTCAGGAGGAGGGGGGTCC GACATCGTCATGACTCAGTCGCCCTCAAGCGTCAGCGCGTCCGTCGGGGACAG AGTGATCATCACCTGTCGGGCGTCCCAGGGAATTCGCAACTGGCTGGCCTGGT ATCAGCAGAAGCCCGGAAAGGCCCCCAACCTGTTGATCTACGCCGCCTCAAAC CTCCAATCCGGGGTGCCGAGCCGCTTCAGCGGCTCCGGTTCGGGTGCCGATTT CACTCTGACCATCTCCTCCCTGCAACCTGAAGATGTGGCTACCTACTACTGCC AAAAGTACAACTCCGCACCTTTTACTTTCGGACCGGGGACCAAAGTGGACATT AAGACCACTACCCCAGCACCGAGGCCACCCACCCCGGCTCCTACCATCGCCTC CCAGCCTCTGTCCCTGCGTCCGGAGGCATGTAGACCCGCAGCTGGTGGGGCCG TGCATACCCGGGGTCTTGACTTCGCCTGCGATATCTACATTTGGGCCCCTCTG GCTGGTACTTGCGGGGTCCTGCTGCTTTCACTCGTGATCACTCTTTACTGTAA GCGCGGTCGGAAGAAGCTGCTGTACATCTTTAAGCAACCCTTCATGAGGCCTG TGCAGACTACTCAAGAGGAGGACGGCTGTTCATGCCGGTTCCCAGAGGAGGAG GAAGGCGGCTGCGAACTGCGCGTGAAATTCAGCCGCAGCGCAGATGCTCCAGC CTACAAGCAGGGGCAGAACCAGCTCTACAACGAACTCAATCTTGGTCGGAGAG AGGAGTACGACGTGCTGGACAAGCGGAGAGGACGGGACCCAGAAATGGGCGGG AAGCCGCGCAGAAAGAATCCCCAAGAGGGCCTGTACAACGAGCTCCAAAAGGA TAAGATGGCAGAAGCCTATAGCGAGATTGGTATGAAAGGGGAACGCAGAAGAG GCAAAGGCCACGACGGACTGTACCAGGGACTCAGCACCGCCACCAAGGACACC TATGACGCTCTTCACATGCAGGCCCTGCCGCCTCGG |

TABLE 8-continued

Amino Acid and Nucleic Acid Sequences of exemplary anti-BCMA scFv domains and BCMA CAR molecules
The amino acid sequences variable heavy chain and variable light chain sequences for each scFv is also provided. Table 2 lists names and CAR construct IDs for several BCMA CARs.

| Name/ Description | SEQ ID NO: | Sequence |
|---|---|---|

149368

| Name/ Description | SEQ ID NO: | Sequence |
|---|---|---|
| 149368-aa ScFv domain | 135 | QVQLVQSGAEVKKPGSSVKVSCKASGGTFSSYAISWVRQAPGQGLEWMGGIIP IFGTANYAQKFQGRVTITADESTSTAYMELSSLRSEDTAVYYCARRGGYQLLR WDVGLLRSAFDIWGQGTMVTVSSGGGGSGGGGSGGGGSSYVLTQPPSVSVAPG QTARITCGGNNIGSKSVHWYQQKPGQAPVLVLYGKNNRPSGVPDRFSGSRSGT TASLTITGAQAEDEADYYCSSRDSSGDHLRVFGTGTKVTVL |
| 149368-nt ScFv domain | 156 | CAAGTGCAGCTGGTCCAGTCGGGCGCCGAGGTCAAGAAGCCCGGGAGCTCTGT GAAAGTGTCCTGCAAGGCCTCCGGGGGCACCTTTAGCTCCTACGCCATCTCCT GGGTCCGCCAAGCACCGGGTCAAGGCCTGGAGTGGATGGGGGGAATTATCCCT ATCTTCGGCACTGCCAACTACGCCCAGAAGTTCCAGGGACGCGTGACCATTAC CGCGGACGAATCCACCTCCACCGCTTATATGGAGCTGTCCAGCTTGCGCTCGG AAGATACCGCCGTGTACTACTGCGCCCGGAGGGGTGGATACCAGCTGCTGAGA TGGGACGTGGGCCTCCTGCGGTCGGCGTTCGACATCTGGGGCCAGGGCACTAT GGTCACTGTGTCCAGCGGAGGAGGCGGATCGGGAGGCGGCGGATCAGGGGGAG GCGGTTCCAGCTACGTGCTTACTCAACCCCCTTCGGTGTCCGTGGCCCCGGGA CAGACCGCCAGAATCACTTGCGGAGGAAACAACATTGGGTCCAAGAGCGTGCA TTGGTACCAGCAGAAGCCAGGACAGGCCCCTGTGCTGGTGCTCTACGGGAAGA ACAATCGGCCCAGCGGAGTGCCGGACAGGTTCTCGGGTTCACGCTCCGGTACA ACCGCTTCACTGACTATCACCGGGGCCCAGGCAGAGGATGAAGCGGACTACTA CTGTTCCTCCCGGGATTCATCCGGCGACCACCTCCGGGTGTTCGGAACCGGAA CGAAGGTCACCGTGCTG |
| 149368-aa VH | 177 | QVQLVQSGAEVKKPGSSVKVSCKASGGTFSSYAISWVRQAPGQGLEWMGGIIP IFGTANYAQKFQGRVTITADESTSTAYMELSSLRSEDTAVYYCARRGGYQLLR WDVGLLRSAFDIWGQGTMVTVSS |
| 149368-aa VL | 198 | SYVLTQPPSVSVAPGQTARITCGGNNIGSKSVHWYQQKPGQAPVLVLYGKNNR PSGVPDRFSGSRSGTTASLTITGAQAEDEADYYCSSRDSSGDHLRVFGTGTKV TVL |
| 149368-aa Full CAR | 219 | MALPVTALLLPLALLLHAARPQVQLVQSGAEVKKPGSSVKVSCKASGGTFSSY AISWVRQAPGQGLEWMGGIIPIFGTANYAQKFQGRVTITADESTSTAYMELSS LRSEDTAVYYCARRGGYQLLRWDVGLLRSAFDIWGQGTMVTVSSGGGGSGGGG SGGGGSSYVLTQPPSVSVAPGQTARITCGGNNIGSKSVHWYQQKPGQAPVLVL YGKNNRPSGVPDRFSGSRSGTTASLTITGAQAEDEADYYCSSRDSSGDHLRVF GTGTKVTVLTTTPAPRPPTPAPTIASQPLSLRPEACRPAAGGAVHTRGLDFAC DIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQG LSTATKDTYDALHMQALPPR |
| 149368-nt Full CAR | 240 | ATGGCCCTCCCTGTCACCGCCCTGCTGCTTCCGCTGGCTCTTCTGCTCCACGC CGCTCGGCCCCAAGTGCAGCTGGTCCAGTCGGGCGCCGAGGTCAAGAAGCCCG GGAGCTCTGTGAAAGTGTCCTGCAAGGCCTCCGGGGGCACCTTTAGCTCCTAC GCCATCTCCTGGGTCCGCCAAGCACCGGGTCAAGGCCTGGAGTGGATGGGGGG AATTATCCCTATCTTCGGCACTGCCAACTACGCCCAGAAGTTCCAGGGACGCG TGACCATTACCGCGGACGAATCCACCTCCACCGCTTATATGGAGCTGTCCAGC TTGCGCTCGGAAGATACCGCCGTGTACTACTGCGCCCGGAGGGGTGGATACCA GCTGCTGAGATGGGACGTGGGCCTCCTGCGGTCGGCGTTCGACATCTGGGGCC AGGGCACTATGGTCACTGTGTCCAGCGGAGGAGGCGGATCGGGAGGCGGCGGA TCAGGGGGAGGCGGTTCCAGCTACGTGCTTACTCAACCCCCTTCGGTGTCCGT GGCCCCGGGACAGACCGCCAGAATCACTTGCGGAGGAAACAACATTGGGTCCA AGAGCGTGCATTGGTACCAGCAGAAGCCAGGACAGGCCCCTGTGCTGGTGCTC TACGGGAAGAACAATCGGCCCAGCGGAGTGCCGGACAGGTTCTCGGGTTCACG CTCCGGTACAACCGCTTCACTGACTATCACCGGGGCCCAGGCAGAGGATGAAG CGGACTACTACTGTTCCTCCCGGGATTCATCCGGCGACCACCTCCGGGTGTTC GGAACCGGAACGAAGGTCACCGTGCTGACCACTACCCCAGCACCGAGGCCACC CACCCCGGCTCCTACCATCGCCTCCCAGCCTCTGTCCCTGCGCGTCGGAGGCAT GTAGACCCGCAGCTGGTGGGCCGTGCATACCCGGGGTCTTGACTTCGCCTGC GATATCTACATTTGGGCCCCTCTGGCTGGTACTTGCGGGGTCCTGCTGCTTTC ACTCGTGATCACTCTTTACTGTAAGCGCGGTCGGAAGAAGCTGCTGTACATCT TTAAGCAACCCTTCATGAGGCCTGTGCAGACTACTCAAGAGGAGGACGGCTGT TCATGCCGGTTCCCAGAGGAGGAGGAAGGCGGCTGCGAACTGCGCGTGAAATT CAGCCGCAGCGCAGATGCTCCAGCCTACAAGCAGGGGCAGAACCAGCTCTACA ACGAACTCAATCTTGGTCGGAGAGAGGAGTACGACGTGCTGGACAAGCGGAGA GGACGGGACCCAGAAATGGGCGGGAAGCCGCGCAGAAAGAATCCCCAAGAGGG CCTGTACAACGAGCTCCAAAAGGATAAGATGGCAGAAGCCTATAGCGAGATTG GTATGAAGGGGAACGCAGAAGAGGCAAAGGCCACGACGGACTGTACCAGGGA CTCAGCACCGCCACCAAGGACACCTATGACGCTCTTCACATGCAGGCCCTGCC GCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | 149369 |
| 149369-aa<br>ScFv domain | 136 | EVQLQQSGPGLVKPSQTLSLTCAISGDSVSSNSAAWNWIRQSPSRGLEWLGRT<br>YYRSKWYSFYAISLKSRIIINPDTSKNQFSLQLKSVTPEDTAVYYCARSSPEG<br>LFLYWFDPWGQGTLVTVSSGGDGSGGGGSGGGGSSSELTQDPAVSVALGQTIR<br>ITCQGDSLGNYYATWYQQKPGQAPVLVIYGTNNRPSGIPDRFSASSSGNTASL<br>TITGAQAEDEADYYCNSRDSSGHHLLFGTGTKVTVL |
| 149369-nt<br>ScFv domain | 157 | GAAGTGCAGCTCCAACAGTCAGGACCGGGGCTCGTGAAGCCATCCCAGACCCT<br>GTCCCTGACTTGTGCCATCTCGGGAGATAGCGTGTCATCGAACTCCGCCGCCT<br>GGAACTGGATTCGGCAGAGCCCGTCCCGCGGACTGGAGTGGCTTGGAAGGACC<br>TACTACCGGTCCAAGTGGTACTCTTTCTACGCGATCTCGCTGAAGTCCCGCAT<br>TATCATTAACCCTGATACCTCCAAGAATCAGTTCTCCCTCCAACTGAAATCCG<br>TCACCCCCGAGGACACAGCAGTGTATTACTGCGCACGGAGCAGCCCCGAAGGA<br>CTGTTCCTGTATTGGTTTGACCCCTGGGGCCAGGGGACTCTTGTGACCGTGTC<br>GAGCGGCGGAGATGGGTCCGGTGGCGGTGGTTCGGGGGGCGGCGGATCATCAT<br>CCGAACTGACCCAGGACCCGGCTGTGTCCGTGGCGCTGGGACAAACCATCCGC<br>ATTACGTGCCAGGGAGACTCCCTGGGCAACTACTACGCCACTTGGTACCAGCA<br>GAAGCCGGGCCAAGCCCCTGTGTTGGTCATCTACGGGACCAACAACAGACCTT<br>CCGGCATCCCCGACCGGTTCAGCGCTTCGTCCTCCGGCAACACTGCCAGCCTG<br>ACCATCACTGGAGCGCAGGCCGAAGATGAGGCCGACTACTACTGCAACAGCAG<br>AGACTCCTCGGGTCATCACCTCTTGTTCGGAACTGGAACCAAGGTCACCGTGC<br>TG |
| 149369-aa<br>VH | 178 | EVQLQQSGPGLVKPSQTLSLTCAISGDSVSSNSAAWNWIRQSPSRGLEWLGRT<br>YYRSKWYSFYAISLKSRIIINPDTSKNQFSLQLKSVTPEDTAVYYCARSSPEG<br>LFLYWFDPWGQGTLVTVSS |
| 149369-aa VL | 199 | SSELTQDPAVSVALGQTIRITCQGDSLGNYYATWYQQKPGQAPVLVIYGTNNR<br>PSGIPDRFSASSSGNTASLTITGAQAEDEADYYCNSRDSSGHHLLFGTGTKVT<br>VL |
| 149369-aa<br>Full CAR | 220 | MALPVTALLLPLALLLHAARPEVQLQQSGPGLVKPSQTLSLTCAISGDSVSSN<br>SAAWNWIRQSPSRGLEWLGRTYYRSKWYSFYAISLKSRIIINPDTSKNQFSLQ<br>LKSVTPEDTAVYYCARSSPEGLFLYWFDPWGQGTLVTVSSGGDGSGGGGSGGG<br>GSSSELTQDPAVSVALGQTIRITCQGDSLGNYYATWYQQKPGQAPVLVIYGTN<br>NRPSGIPDRFSASSSGNTASLTITGAQAEDEADYYCNSRDSSGHHLLFGTGTK<br>VTVLTTTPAPRPPTPAPTIASQPLSLRPEACRPAAGGAVHTRGLDFACDIYIW<br>APLAGTCGVLLLSLVITLYCKRGRKKLLYIFKQPFMRPVQTTQEEDGCSCRFP<br>EEEEGGCELRVKFSRSADAPAYKQGQNQLYNELNLGRREEYDVLDKRRGRDPE<br>MGGKPRRKNPQEGLYNELQKDKMAEAYSEIGMKGERRRGKGHDGLYQGLSTAT<br>KDTYDALHMQALPPR |
| 149369-nt<br>Full CAR | 241 | ATGGCCCTCCCTGTCACCGCCCTGCTGCTTCCGCTGGCTCTTCTGCTCCACGC<br>CGCTCGGCCCGAAGTGCAGCTCCAACAGTCAGGACCGGGGCTCGTGAAGCCAT<br>CCCAGACCCTGTCCCTGACTTGTGCCATCTCGGGAGATAGCGTGTCATCGAAC<br>TCCGCCGCCTGGAACTGGATTCGGCAGAGCCCGTCCCGCGGACTGGAGTGGCT<br>TGGAAGGACCTACTACCGGTCCAAGTGGTACTCTTTCTACGCGATCTCGCTGA<br>AGTCCCGCATTATCATTAACCCTGATACCTCCAAGAATCAGTTCTCCCTCCAA<br>CTGAAATCCGTCACCCCCGAGGACACAGCAGTGTATTACTGCGCACGGAGCAG<br>CCCCGAAGGACTGTTCCTGTATTGGTTTGACCCCTGGGGCCAGGGGACTCTTG<br>TGACCGTGTCGAGCGGCGGAGATGGGTCCGGTGGCGGTGGTTCGGGGGGCGGC<br>GGATCATCATCCGAACTGACCCAGGACCCGGCTGTGTCCGTGGCGCTGGGACA<br>AACCATCCGCATTACGTGCCAGGGAGACTCCCTGGGCAACTACTACGCCACTT<br>GGTACCAGCAGAAGCCGGGCCAAGCCCCTGTGTTGGTCATCTACGGGACCAAC<br>AACAGACCTTCCGGCATCCCCGACCGGTTCAGCGCTTCGTCCTCCGGCAACAC<br>TGCCAGCCTGACCATCACTGGAGCGCAGGCCGAAGATGAGGCCGACTACTACT<br>GCAACAGCAGAGACTCCTCGGGTCATCACCTCTTGTTCGGAACTGGAACCAAG<br>GTCACCGTGCTGACCACTACCCCAGCACCGAGGCACCCACCCCGGCTCCTAC<br>CATCGCCTCCCAGCCTCTGTCCCTGCGTCCGGAGGCATGTAGACCCGCAGCTG<br>GTGGGGCCGTGCATACCCGGGGTCTTGACTTCGCCTGCGATATCTACATTTGG<br>GCCCCTCTGGCTGGTACTTGCGGGGTCCTGCTGCTTTCACTCGTGATCACTCT<br>TTACTGTAAGCGCGGTCGGAAGAAGCTGCTGTACATCTTTAAGCAACCCTTCA<br>TGAGGCCTGTGCAGACTACTCAAGAGGAGGACGGCTGTTCATGCCGGTTCCCA<br>GAGGAGGAGGAAGGCGGCTGCGAACTGCGCGTGAAATTCAGCCGCAGCGCAGA<br>TGCTCCAGCCTACAAGCAGGGGCAGAACCAGCTCTACAACGAACTCAATCTTG<br>GTCGGAGAGAGGAGTACGACGTGCTGGACAAGCGGAGAGGACGGGACCCAGAA<br>ATGGGCGGGAAGCCGCGCAGAAAGAATCCCCAAGAGGGCCTGTACAACGAGCT<br>CCAAAAGGATAAGATGGCAGAAGCCTATAGCGAGATTGGTATGAAAGGGGAAC<br>GCAGAAGAGGCAAAGGCCACGACGGACTGTACCAGGGACTCAGCACCGCCACC<br>AAGGACACCTATGACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| colspan="3" | BCMA_EBB-C1978-A4 |
| BCMA_EBB-<br>C1978-A4 -<br>aa<br>ScFv domain | 137 | EVQLVESGGGLVQPGGSLRLSCAASGFTFSSYAMSWVRQAPGKGLEWVSAISG<br>SGGSTYYADSVKGRFTISRDNSKNTLYLQMNSLRAEDTAVYYCAKVEGSGSLD<br>YWGQGTLVTVSSGGGGSGGGGSGGGGSEIVMTQSPGTLSLSPGERATLSCRAS<br>QSVSSAYLAWYQQKPGQPPRLLISGASTRATGIPDRFGGSGSGTDFTLTISRL<br>EPEDFAVYYCQHYGSSFNGSSLFTFGQGTRLEIK |
| BCMA_EBB-<br>C1978-A4 - nt<br>ScFv domain | 158 | GAAGTGCAGCTCGTGGAGTCAGGAGGCGGCCTGGTCCAGCCGGGAGGGTCCCT<br>TAGACTGTCATGCGCCGCAAGCGGATTCACTTTCTCCTCCTATGCCATGAGCT<br>GGGTCCGCCAAGCCCCCGGAAAGGGACTGGAATGGGTGTCCGCCATCTCGGGG<br>TCTGGAGGCTCAACTTACTACGCTGACTCCGTGAAGGGACGGTTCACCATTAG<br>CCGCGACAACTCCAAGAACACCCTCTACCTCCAAATGAACTCCCTGCGGGCCG<br>AGGATACCGCCGTCTACTACTGCGCCAAAGTGGAAGGTTCAGGATCGCTGGAC<br>TACTGGGGACAGGGTACTCTCGTGACCGTGTCATCGGGCGGAGGAGGTTCCGG<br>CGGTGGCGGCTCCGGCGGCGGAGGGTCGGAGATCGTGATGACCCAGAGCCCTG<br>GTACTCTGAGCCTTTCGCCGGGAGAAAGGGCCACCCTGTCCTGCCGCGCTTCC<br>CAATCCGTGTCCTCCGCGTACTTGGCGTGGTACCAGCAGAAGCCGGGACAGCC<br>CCCTCGGCTGCTGATCAGCGGGGCCAGCACCCGGGCAACCGGAATCCCAGACA<br>GATTCGGGGGTTCCGGCAGCGGCACAGATTTCACCCTGACTATTTCGAGGTTG<br>GAGCCCGAGGACTTTGCGGTGTATTACTGTCAGCACTACGGGTCGTCCTTTAA<br>TGGCTCCAGCCTGTTCACGTTCGGACAGGGGACCCGCCTGGAAATCAAG |
| BCMA_EBB-<br>C1978-A4 -<br>aa<br>VH | 179 | EVQLVESGGGLVQPGGSLRLSCAASGFTFSSYAMSWVRQAPGKGLEWVSAISG<br>SGGSTYYADSVKGRFTISRDNSKNTLYLQMNSLRAEDTAVYYCAKVEGSGSLD<br>YWGQGTLVTVSS |
| BCMA_EBB-<br>C1978-A4 -<br>aa<br>VL | 200 | EIVMTQSPGTLSLSPGERATLSCRASQSVSSAYLAWYQQKPGQPPRLLISGAS<br>TRATGIPDRFGGSGSGTDFTLTISRLEPEDFAVYYCQHYGSSFNGSSLFTFGQ<br>GTRLEIK |
| BCMA_EBB-<br>C1978-A4 -<br>aa<br>Full CART | 221 | MALPVTALLLPLALLLHAARPEVQLVESGGGLVQPGGSLRLSCAASGFTFSSY<br>AMSWVRQAPGKGLEWVSAISGSGGSTYYADSVKGRFTISRDNSKNTLYLQMNS<br>LRAEDTAVYYCAKVEGSGSLDYWGQGTLVTVSSGGGGSGGGGSGGGGSEIVMT<br>QSPGTLSLSPGERATLSCRASQSVSSAYLAWYQQKPGQPPRLLISGASTRATG<br>IPDRFGGSGSGTDFTLTISRLEPEDFAVYYCQHYGSSFNGSSLFTFGQGTRLE<br>IKTTTPAPRPPTPAPTIASQPLSLRPEACRPAAGGAVHTRGLDFACDIYIWAP<br>LAGTCGVLLLSLVITLYCKRGRKKLLYIFKQPFMRPVQTTQEEDGCSCRFPEE<br>EEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKD<br>TYDALHMQALPPR |
| BCMA_EBB-<br>C1978-A4 - nt<br>Full CART | 242 | ATGGCCCTCCCTGTCACCGCCCTGCTGCTTCCGCTGGCTCTTCTGCTCCACGC<br>CGCTCGGCCCGAAGTGCAGCTCGTGGAGTCAGGAGGCGGCCTGGTCCAGCCGG<br>GAGGGTCCCTTAGACTGTCATGCGCCGCAAGCGGATTCACTTTCTCCTCCTAT<br>GCCATGAGCTGGGTCCGCCAAGCCCCCGGAAAGGGACTGGAATGGGTGTCCGC<br>CATCTCGGGGTCTGGAGGCTCAACTTACTACGCTGACTCCGTGAAGGGACGGT<br>TCACCATTAGCCGCGACAACTCCAAGAACACCCTCTACCTCCAAATGAACTCC<br>CTGCGGGCCGAGGATACCGCCGTCTACTACTGCGCCAAAGTGGAAGGTTCAGG<br>ATCGCTGGACTACTGGGGACAGGGTACTCTCGTGACCGTGTCATCGGGCGGAG<br>GAGGTTCCGGCGGTGGCGGCTCCGGCGGCGGAGGGTCGGAGATCGTGATGACC<br>CAGAGCCCTGGTACTCTGAGCCTTTCGCCGGGAGAAAGGGCCACCCTGTCCTG<br>CCGCGCTTCCCAATCCGTGTCCTCCGCGTACTTGGCGTGGTACCAGCAGAAGC<br>CGGGACAGCCCCCTCGGCTGCTGATCAGCGGGGCCAGCACCCGGGCAACCGGA<br>ATCCCAGACAGATTCGGGGGTTCCGGCAGCGGCACAGATTTCACCCTGACTAT<br>TTCGAGGTTGGAGCCCGAGGACTTTGCGGTGTATTACTGTCAGCACTACGGGT<br>CGTCCTTTAATGGCTCCAGCCTGTTCACGTTCGGACAGGGGACCCGCCTGGAA<br>ATCAAGACCACTACCCCAGCACCGAGGCCACCCACCCCGGCTCCTACCATCGC<br>CTCCCAGCCTCTGTCCCTGCGTCCGGAGGCATGTAGACCCGCAGCTGGTGGGG<br>CCGTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTACTG<br>TAAGCGCGGTCGGAAGAAGCTGCTGTACATCTTTAAGCAACCCTTCATGAGGC<br>CTGTGCAGACTACTCAAGAGGAGGACGGCTGTTCATGCCGGTTCCCAGAGGAG<br>GAGGAAGGCGGCTGCGAACTGCGCGTGAAATTCAGCCGCAGCGCAGATGCTCC<br>AGCCTACAAGCAGGGGCAGAACCAGCTCTACAACGAACTCAATCTTGGTCGGA<br>GAGAGGAGTACGACGTGCTGGACAAGCGGAGAGGACGGGACCCAGAAATGGGC<br>GGGAAGCCGCGCAGAAAGAATCCCAAGAGGGCCTGTACAACGAGCTCCAAAA<br>GGATAAGATGGCAGAAGCCTATAGCGAGATTGGTATGAAAGGGGAACGCAGAA<br>GAGGCAAAGGCCACGACGGACTGTACCAGGGACTCAGCACCGCCACCAAGGAC<br>ACCTATGACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| BCMA_EBB-C1978-G1 | | |
| BCMA_EBB-<br>C1978-G1 -<br>aa<br>ScFv domain | 138 | EVQLVETGGGLVQPGGSLRLSCAASGITFSRYPMSWVRQAPGKGLEW<br>VSGISDSGVSTYYADSAKGRFTISRDNSKNTLFLQMSSLRDEDTAVYY<br>CVTRAGSEASDIWGQGTMVTVSSGGGGSGGGGSGGGGSEIVLTQSPAT<br>LSLSPGERATLSCRASQSVSNSLAWYQQKPGQAPRLLIYDASSRATGIP<br>DRFSGSGSGTDFTLTISRLEPEDFAIYYCQQFGTSSGLTFGGGTKLEIK |
| BCMA_EBB-<br>C1978-G1 -<br>nt<br>ScFv domain | 159 | GAAGTGCAACTGGTGGAAACCGGTGGCGGCCTGGTGCAGCCTGGAGGATCATT<br>GAGGCTGTCATGCGCGGCCAGCGGTATTACCTTCTCCCGGTACCCCATGTCCT<br>GGGTCAGACAGGCCCCGGGGAAAGGGCTTGAATGGGTGTCCGGGATCTCGGAC<br>TCCGGTGTCAGCACTTACTACGCCGACTCCGCCAAGGGACGCTTCACCATTTC<br>CCGGGACAACTCGAAGAACACCCTGTTCCTCCAAATGAGCTCCTCCGGGACG<br>AGGATACTGCAGTGTACTACTGCGTGACCCGCGCCGGGTCCGAGGCGTCTGAC<br>ATTTGGGGACAGGGCACTATGGTCACCGTGTCGTCCGGCGGAGGGGGCTCGGG<br>AGGCGGTGGCAGCGGAGGAGGAGGGTCCGAGATCGTGCTGACCCAATCCCCGG<br>CCACCCTCTCGCTGAGCCCGGAGAAAGGGCAACCTTGTCCTGTCGCGCGAGC<br>CAGTCCGTGAGCAACTCCCTGGCCTGGTACCAGCAGAAGCCCGGACAGGCTCC<br>GAGACTTCTGATCTACGACGCTTCGAGCCGGGCCACTGGAATCCCCGACCGCT<br>TTTCGGGGTCCGGCTCAGGAACCGATTTCACCCTGACAATCTCACGGCTGGAG<br>CCAGAGGATTTCGCCATCTATTACTGCCAGCAGTTCGGTACTTCCTCCGGCCT<br>GACTTTCGGAGGCGGCACGAAGCTCGAAATCAAG |
| BCMA_EBB-<br>C1978-G1 -<br>aa<br>VH | 180 | EVQLVETGGGLVQPGGSLRLSCAASGITFSRYPMSWVRQAPGKGLEWVSGISD<br>SGVSTYYADSAKGRFTISRDNSKNTLFLQMSSLRDEDTAVYYCVTRAGSEASD<br>IWGQGTMVTVSS |
| BCMA_EBB-<br>C1978-G1 -<br>aa<br>VL | 201 | EIVLTQSPATLSLSPGERATLSCRASQSVSNSLAWYQQKPGQAPRLLIYDASS<br>RATGIPDRFSGSGSGTDFTLTISRLEPEDFAIYYCQQFGTSSGLTFGGGTKLE<br>IK |
| BCMA_EBB-<br>C1978-G1 -<br>aa<br>Full CART | 222 | MALPVTALLLPLALLLHAARPEVQLVETGGGLVQPGGSLRLSCAASGI<br>TFSRYPMSWVRQAPGKGLEWVSGISDSGVSTYYADSAKGRFTISRDNS<br>KNTLFLQMSSLRDEDTAVYYCVTRAGSEASDIWGQGTMVTVSSGGGG<br>SGGGGSGGGGSEIVLTQSPATLSLSPGERATLSCRASQSVSNSLAWYQQ<br>KPGQAPRLLIYDASSRATGIPDRFSGSGSGTDFTLTISRLEPEDFAIYYCQ<br>QFGTSSGLTFGGGTKLEIKTTTPAPRPPTPAPTIASQPLSLRPEACRPAAG<br>GAVHTRGLDFACDIYIWAPLAGTCGVLLLSLVITLYCKRGRKKLLYIFK<br>QPFMRPVQTTQEEDGCSCRFPEEEEGGCELRVKFSRSADAPAYKQGQN<br>QLYNELNLGRREEYDVLDKRRGRDPEMGGKPRRKNPQEGLYNELQK<br>DKMAEAYSEIGMKGERRRGKGHDGLYQGLSTATKDTYDALHMQALP<br>PR |
| BCMA_EBB-<br>C1978-G1 -<br>nt<br>Full CART | 243 | ATGGCCCTCCCTGTCACCGCCCTGCTGCTTCCGCTGGCTCTTCTGCTCCACGC<br>CGCTCGGCCCGAAGTGCAACTGGTGGAAACCGGTGGCGGCCTGGTGCAGCCTG<br>GAGGATCATTGAGGCTGTCATGCGCGGCCAGCGGTATTACCTTCTCCCGGTAC<br>CCCATGTCCTGGGTCAGACAGGCCCCGGGGAAAGGGCTTGAATGGGTGTCCGG<br>GATCTCGGACTCCGGTGTCAGCACTTACTACGCCGACTCCGCCAAGGGACGCT<br>TCACCATTTCCCGGGACAACTCGAAGAACACCCTGTTCCTCCAAATGAGCTCC<br>CTCCGGGACGAGGATACTGCAGTGTACTACTGCGTGACCCGCGCCGGGTCCGA<br>GGCGTCTGACATTTGGGGACAGGGCACTATGGTCACCGTGTCGTCCGGCGGAG<br>GGGGCTCGGGAGGCGGTGGCAGCGGAGGAGGAGGGTCCGAGATCGTGCTGACC<br>CAATCCCCGGCCACCCTCTCGCTGAGCCCGGAGAAAGGGCAACCTTGTCCTG<br>TCGCGCGAGCCAGTCCGTGAGCAACTCCCTGGCCTGGTACCAGCAGAAGCCCG<br>GACAGGCTCCGAGACTTCTGATCTACGACGCTTCGAGCCGGGCCACTGGAATC<br>CCCGACCGCTTTTCGGGGTCCGGCTCAGGAACCGATTTCACCCTGACAATCTC<br>ACGGCTGGAGCCAGAGGATTTCGCCATCTATTACTGCCAGCAGTTCGGTACTT<br>CCTCCGGCCTGACTTTCGGAGGCGGCACGAAGCTCGAAATCAAGACCACTACC<br>CCAGCACCGAGGCCACCCACCCCGGCTCCTACCATCGCCTCCCAGCCTCTGTC<br>CCTGCGTCCGGAGGCATGTAGACCCGCAGCTGGTGGGCCGTGCATACCCGGG<br>GTCTTGACTTCGCCTGCGATATCTACATTTGGGCCCCTCTGCCTGGTACTTGC<br>GGGGTCCTGCTGCTTTCACTCGTGATCACTCTTTACTGTAAGCGCGGTCGGAA<br>GAAGCTGCTGTACATCTTTAAGCAACCCTTCATGAGGCCTGTGCAGACTACTC<br>AAGAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAGGG<br>GCAGAACCAGCTCTACAACGAACTCAATCTTGGTCGGAGAGAGGAGTACGACG<br>TGCTGGACAAGCGGAGAGGACGGGACCCAGAAATGGGCGGGAAGCCGCGCAGA<br>AAGAATCCCAAGAGGGCCTGTACAACGAGCTCCAAAAGGATAAGATGGCAGA<br>AGCCTATAGCGAGATTGGTATGAAGGGGAACGCAGAAGAGGCAAAGGCCACG<br>ACGGACTGTACCAGGGACTCAGCACCGCCACCAAGGACACCTATGACGCTCTT<br>CACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | BCMA_EBB-C1979-C1 |
| BCMA_EBB-<br>C1979-C1 -<br>aa<br>ScFv domain | 139 | QVQLVESGGGLVQPGGSLRLSCAASGFTFSSYAMSWVRQAPGKGLEWVSAISG<br>SGGSTYYADSVKGRFTISRDNAKNSLYLQMNSLRAEDTAIYYCARATYKRELR<br>YYYGMDVWGQGTMVTVSSGGGGSGGGGSGGGGSEIVMTQSPGTVSLSPGERAT<br>LSCRASQSVSSSFLAWYQQKPGQAPRLLIYGASSRATGIPDRFSGSGSGTDFT<br>LTISRLEPEDSAVYYCQQYHSSPSWTFGQGTRLEIK |
| BCMA_EBB-<br>C1979-C1 - nt<br>ScFv domain | 160 | CAAGTGCAGCTCGTGGAATCGGGTGGCGGACTGGTGCAGCCGGGGGGCTCACT<br>TAGACTGTCCTGCGCGGCCAGCGGATTCACTTTCTCCTCCTACGCCATGTCCT<br>GGGTCAGACAGGCCCCTGGAAAGGGCCTGGAATGGGTGTCCGCAATCAGCGGC<br>AGCGGCGGCTCGACCTATTACGCGGATTCAGTGAAGGGCAGATTCACCATTTC<br>CCGGGACAACGCCAAGAACTCCTTGTACCTTCAAATGAACTCCCTCCGCGCGG<br>AAGATACCGCAATCTACTACTGCGCTCGGGCCACTTACAAGAGGGAACTGCGC<br>TACTACTACGGGATGGACGTCTGGGGCCAGGGAACCATGGTCACCGTGTCCAG<br>CGGAGGAGGAGGATCGGGAGGAGGCGGTAGCGGGGGTGGAGGGTCGGAGATCG<br>TGATGACCCAGTCCCCCGGCACTGTGTCGCTGTCCCCCGGCGAACGGGCCACC<br>CTGTCATGTCGGGCCAGCCAGTCAGTGTCGTCAAGCTTCCTCGCCTGGTACCA<br>GCAGAAACCGGGACAAGCTCCCCGCCTGCTGATCTACGGAGCCAGCAGCCGGG<br>CCACCGGTATTCCTGACCGGTTCTCCGGTTCGGGGTCCGGGACCGACTTTACT<br>CTGACTATCTCTCGCCTCGAGCCAGAGGACTCCGCCGTGTATTACTGCCAGCA<br>GTACCACTCCTCCCCGTCCTGGACGTTCGGACAGGGCACAAGGCTGGAGATTA<br>AG |
| BCMA_EBB-<br>C1979-C1 -<br>aa<br>VH | 181 | QVQLVESGGGLVQPGGSLRLSCAASGFTFSSYAMSWVRQAPGKGLEWVSAISG<br>SGGSTYYADSVKGRFTISRDNAKNSLYLQMNSLRAEDTAIYYCARATYKRELR<br>YYYGMDVWGQGTMVTVSS |
| BCMA_EBB-<br>C1979-C1 -<br>aa<br>VL | 202 | EIVMTQSPGTVSLSPGERATLSCRASQSVSSSFLAWYQQKPGQAPRLLIYGAS<br>SRATGIPDRFSGSGSGTDFTLTISRLEPEDSAVYYCQQYHSSPSWTFGQGTRL<br>EIK |
| BCMA_EBB-<br>C1979-C1 -<br>aa<br>Full CART | 223 | MALPVTALLLPLALLLHAARPQVQLVESGGGLVQPGGSLRLSCAASGFTFSSY<br>AMSWVRQAPGKGLEWVSAISGSGGSTYYADSVKGRFTISRDNAKNSLYLQMNS<br>LRAEDTAIYYCARATYKRELRYYYGMDVWGQGTMVTVSSGGGGSGGGGSGGGG<br>SEIVMTQSPGTVSLSPGERATLSCRASQSVSSSFLAWYQQKPGQAPRLLIYGA<br>SSRATGIPDRFSGSGSGTDFTLTISRLEPEDSAVYYCQQYHSSPSWTFGQGTR<br>LEIKTTTPAPRPPTPAPTIASQPLSLRPEACRPAAGGAVHTRGLDFACDIYIW<br>APLAGTCGVLLLSLVITLYCKRGRKKLLYIFKQPFMRPVQTTQEEDGCSCRFP<br>EEEEGGCELRVKFSRSADAPAYKQGQNQLYNELNLGRREEYDVLDKRRGRDPE<br>MGGKPRRKNPQEGLYNELQKDKMAEAYSEIGMKGERRRGKGHDGLYQGLSTAT<br>KDTYDALHMQALPPR |
| BCMA_EBB-<br>C1979-C1 - nt<br>Full CART | 244 | ATGGCCCTCCCTGTCACCGCCCTGCTGCTTCCGCTGGCTCTTCTGCTCCACGC<br>CGCTCGGCCCCAAGTGCAGCTCGTGGAATCGGGTGGCGGACTGGTGCAGCCGG<br>GGGGCTCACTTAGACTGTCCTGCGCGGCCAGCGGATTCACTTTCTCCTCCTAC<br>GCCATGTCCTGGGTCAGACAGGCCCCTGGAAAGGGCCTGGAATGGGTGTCCGC<br>AATCAGCGGCAGCGGCGGCTCGACCTATTACGCGGATTCAGTGAAGGGCAGAT<br>TCACCATTTCCCGGGACAACGCCAAGAACTCCTTGTACCTTCAAATGAACTCC<br>CTCCGCGCGGAAGATACCGCAATCTACTACTGCGCTCGGGCCACTTACAAGAG<br>GGAACTGCGCTACTACTACGGGATGGACGTCTGGGGCCAGGGAACCATGGTCA<br>CCGTGTCCAGCGGAGGAGGAGGATCGGGAGGAGGCGGTAGCGGGGGTGGAGGG<br>TCGGAGATCGTGATGACCCAGTCCCCCGGCACTGTGTCGCTGTCCCCCGGCGA<br>ACGGGCCACCCTGTCATGTCGGGCCAGCCAGTCAGTGTCGTCAAGCTTCCTCG<br>CCTGGTACCAGCAGAAACCGGGACAAGCTCCCCGCCTGCTGATCTACGGAGCC<br>AGCAGCCGGGCCACCGGTATTCCTGACCGGTTCTCCGGTTCGGGGTCCGGGAC<br>CGACTTTACTCTGACTATCTCTCGCCTCGAGCCAGAGGACTCCGCCGTGTATT<br>ACTGCCAGCAGTACCACTCCTCCCCGTCCTGGACGTTCGGACAGGGCACAAGG<br>CTGGAGATTAAGACCACTACCCCAGCACCGAGGCACCCACCCCGGCTCCTAC<br>CATCGCCTCCCAGCCTGTCCCTGCGTCCGGAGGCATGTAGACCCGCAGCTG<br>GTGGGGCCGTGCATACCCGGGGTCTTGACTTCGCCTGCGATATCTACATTTGG<br>GCCCCTCTGGCTGGTACTTGCGGGGTCCTGCTGCTTTCACTCGTGATCACTCT<br>TTACTGTAAGCGCGGTCGGAAGAAGCTGCTGTACATCTTTAAGCAACCCTTCA<br>TGAGGCCTGTGCAGACTACTCAAGAGGAGGACGGCTGTTCATGCCGGTTCCCA<br>GAGGAGGAGGAAGGCGGCTGCGAACTGCGCGTGAAATTCAGCCGCAGCGCAGA<br>TGCTCCAGCCTACAAGCAGGGGCAGAACCAGCTCTACAACGACTCAATCTTG<br>GTCGGAGAGAGGAGTACGACGTGCTGGACAAGCGGAGGACGGGACCCAGAA<br>ATGGGCGGGAAGCCGCGCAGAAAGAATCCCCAAGAGGGCCTGTACAACGAGCT<br>CCAAAAGGATAAGATGGCAGAAGCCTATAGCGAGATTGGTATGAAAGGGGAAC<br>GCAGAAGAGGCAAAGGCCACGACGGACTGTACCAGGGACTCAGCACCGCCACC<br>AAGGACACCTATGACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
| --- | --- | --- |
| BCMA_EBB-C1978-C7 | | |
| BCMA_EBB-C1978-C7 - aa ScFv domain | 140 | EVQLVETGGGLVQPGGSLRLSCAASGFTFSSYAMSWVRQAPGKGLEWVSAISG SGGSTYYADSVKGRFTISRDNSKNTLYLQMNTLKAEDTAVYYCARATYKRELR YYYGMDVWGQGTTVTVSSGGGGSGGGGSGGGGSEIVLTQSPSTLSLSPGESAT LSCRASQSVSTTFLAWYQQKPGQAPRLLIYGSSNRATGIPDRFSGSGSGTDFT LTIRRLEPEDFAVYYCQQYHSSPSWTFGQGTKVEIK |
| BCMA_EBB-C1978-C7 - nt ScFv domain | 161 | GAGGTGCAGCTTGTGGAAACCGGTGGCGGACTGGTGCAGCCCGGAGGAAGCCT CAGGCTGTCCTGCGCCGCGTCCGGCTTCACCTTCTCCTCGTACGCCATGTCCT GGGTCCGCCAGGCCCCCGGAAAGGGCCTGGAATGGGTGTCCGCCATCTCTGGA AGCGGAGGTTCCACGTACTACGCGGACAGCGTCAAGGGAAGGTTCACAATCTC CCGCGATAATTCGAAGAACACTCTGTACCTTCAAATGAACACCCTGAAGGCCG AGGACACTGCTGTGTACTACTGCGCACGGGCCACCTACAAGAGAGAGCTCCGG TACTACTACGGAATGGACGTCTGGGGCCAGGGAACTACTGTGACCGTGTCCTC GGGAGGGGGTGGCTCCGGGGGGGGCGGCTCCGGCGGAGGCGGTTCCGAGATTG TGCTGACCCAGTCACCTTCAACTCTGTCGCTGTCCCCGGGAGAGAGCGCTACT CTGAGCTGCCGGGCCAGCCAGTCCGTGTCCACCACCTTCCTCGCCTGGTATCA GCAGAAGCCGGGGCAGGCACCACGGCTCTTGATCTACGGGTCAAGCAACAGAG CGACCGGAATTCCTGACCGCTTCTCGGGGAGCGGTTCAGGCACCGACTTCACC CTGACTATCCGGCGCCTGGAACCCGAAGATTTCGCCGTGTATTACTGTCAACA GTACCACTCCTCGCCGTCCTGGACCTTTGGCCAAGGAACCAAAGTGGAAATCA AG |
| BCMA_EBB-C1978-C7 - aa VH | 182 | EVQLVETGGGLVQPGGSLRLSCAASGFTFSSYAMSWVRQAPGKGLEWVSAISG SGGSTYYADSVKGRFTISRDNSKNTLYLQMNTLKAEDTAVYYCARATYKRELR YYYGMDVWGQGTTVTVSS |
| BCMA_EBB-C1978-C7 - aa VL | 203 | EIVLTQSPSTLSLSPGESATLSCRASQSVSTTFLAWYQQKPGQAPRLLIYGSS NRATGIPDRFSGSGSGTDFTLTIRRLEPEDFAVYYCQQYHSSPSWTFGQGTKV EIK |
| BCMA_EBB-C1978-C7 - aa Full CART | 224 | MALPVTALLLPLALLLHAARPEVQLVETGGGLVQPGGSLRLSCAASGFTFSSY AMSWVRQAPGKGLEWVSAISGSGGSTYYADSVKGRFTISRDNSKNTLYLQMNT LKAEDTAVYYCARATYKRELRYYYGMDVWGQGTTVTVSSGGGGSGGGGSGGGG SEIVLTQSPSTLSLSPGESATLSCRASQSVSTTFLAWYQQKPGQAPRLLIYGS SNRATGIPDRFSGSGSGTDFTLTIRRLEPEDFAVYYCQQYHSSPSWTFGQGTK VEIKTTTPAPRPPTPAPTIASQPLSLRPEACRPAAGGAVHTRGLDFACDIYIW APLAGTCGVLLLSLVITLYCKRGRKKLLYIFKQPFMRPVQTTQEEDGCSCRFP EEEEGGCELRVKFSRSADAPAYKQGQNQLYNELNLGRREEYDVLDKRRGRDPE MGGKPRRKNPQEGLYNELQKDKMAEAYSEIGMKGERRRGKGHDGLYQGLSTAT KDTYDALHMQALPPR |
| BCMA_EBB-C1978-C7 - nt Full CART | 245 | ATGGCCCTCCCTGTCACCGCCCTGCTGCTTCCGCTGGCTCTTCTGCTCCACGC CGCTCGGCCCGAGGTGCAGCTTGTGGAAACCGGTGGCGGACTGGTGCAGCCCG GAGGAAGCCTCAGGCTGTCCTGCGCCGCGTCCGGCTTCACCTTCTCCTCGTAC GCCATGTCCTGGGTCCGCCAGGCCCCCGGAAAGGGCCTGGAATGGGTGTCCGC CATCTCTGGAAGCGGAGGTTCCACGTACTACGCGGACAGCGTCAAGGGAAGGT TCACAATCTCCCGCGATAATTCGAAGAACACTCTGTACCTTCAAATGAACACC CTGAAGGCCGAGGACACTGCTGTGTACTACTGCGCACGGGCCACCTACAAGAG AGAGCTCCGGTACTACTACGGAATGGACGTCTGGGGCCAGGGAACTACTGTGA CCGTGTCCTCGGGAGGGGGTGGCTCCGGGGGGGGCGGCTCCGGCGGAGGCGGT TCCGAGATTGTGCTGACCCAGTCACCTTCAACTCTGTCGCTGTCCCCGGGAGA GAGCGCTACTCTGAGCTGCCGGGCCAGCCAGTCCGTGTCCACCACCTTCCTCG CCTGGTATCAGCAGAAGCCGGGGCAGGCACCACGGCTCTTGATCTACGGGTCA AGCAACAGAGCGACCGGAATTCCTGACCGCTTCTCGGGGAGCGGTTCAGGCAC CGACTTCACCCTGACTATCCGGCGCCTGGAACCCGAAGATTTCGCCGTGTATT ACTGTCAACAGTACCACTCCTCGCCGTCCTGGACCTTTGGCCAAGGAACCAAA GTGGAAATCAAGACCACTACCCCAGCACCGAGGCCACCCACCCCGGCTCCTAC CATCGCCTCCCAGCCTCTGTCCCTGCGTCCGGAGGCATGTAGACCCGCAGCTG GTGGGGCCGTGCATACCCGGGTCTTGACTTCGCCTGCGATATCTACATTTGG GCCCCTCTGGCTGGTACTTGCGGGGTCCTGCTGCTTTCACTCGTGATCACTCT TTACTGTAAGCGCGGTCGGAAGAAGCTGCTGTACATCTTTAAGCAACCCTTCA TGAGGCCTGTGCAGACTACTCAAGAGGAGGACGGCTGTTCATGCCGGTTCCCA GAGGAGGAGGAAGGCGGCTGCGAACTGCGCGTGAAATTCAGCCGCAGCGCAGA TGCTCCAGCCTACAAGCAGGGGCAGAACCAGCTCTACAACGAACTCAATCTTG GTCGGAGAGAGGAGTACGACGTGCTGGACAAGCGGAGAGGACGGGACCCAGAA ATGGGCGGGAAGCCGCGCAGAAAGAATCCCCAAGAGGGCCTGTACAACGAGCT CCAAAAGGATAAGATGGCAGAAGCCTATAGCGAGATTGGTATGAAAGGGGAAC GCAGAAGAGGCAAAGGCCACGACGGACTGTACCAGGGACTCAGCACCGCCACC AAGGACACCTATGACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| BCMA_EBB-C1978-D10 | | |
| BCMA_EBB-01978-D10-aa ScFv domain | 141 | EVQLVETGGGLVQPGRSLRLSCAASGFTFDDYAMHWVRQAPGKGLEWVSGISW<br>NSGSIGYADSVKGRFTISRDNAKNSLYLQMNSLRDEDTAVYYCARVGKAVPDV<br>WGQGTTVTVSSGGGGSGGGGSGGGGSDIVMTQTPSSLSASVGDRVTITCRASQ<br>SISSYLNWYQQKPGKAPKLLIYAASSLQSGVPSRFSGSGSGTDFTLTISSLQP<br>EDFATYYCQQSYSTPYSFGQGTRLEIK |
| BCMA_EBB-C1978-D10-nt ScFv domain | 162 | GAAGTGCAGCTCGTGGAAACTGGAGGTGGACTCGTGCAGCCTGGACGGTCGCT<br>GCGGCTGAGCTGCGCTGCATCCGGCTTCACCTTCGACGATTATGCCATGCACT<br>GGGTCAGACAGGCGCCAGGGAAGGGACTTGAGTGGGTGTCCGGTATCAGCTGG<br>AATAGCGGCTCAATCGGATACGCGGACTCCGTGAAGGGAAGGTTCACCATTTC<br>CCGCGACAACGCCAAGAACTCCCTGTACTTGCAAATGAACAGCCTCCGGGATG<br>AGGACACTGCCGTGTACTACTGCGCCCGCGTCGGAAAAGCTGTGCCCGACGTC<br>TGGGGCCAGGGAACCACTGTGACCGTGTCCAGCGGCGGGGGTGGATCGGGCGG<br>TGGAGGGTCCGGTGGAGGGGGCTCAGATATTGTGATGACCCAGACCCCCTCGT<br>CCCTGTCCGCCTCGGTCGGCGACCGCGTGACTATCACATGTAGAGCCTCGCAG<br>AGCATCTCCAGCTACCTGAACTGGTATCAGCAGAAGCCGGGGAAGGCCCCGAA<br>GCTCCTGATCTACGCGGCATCATCACTGCAATCGGGAGTGCCGAGCCGGTTTT<br>CCGGGTCCGGCTCCGGCACCGACTTCACGCTGACCATTTCTTCCCTGCAACCC<br>GAGGACTTCGCCACTTACTACTGCCAGCAGTCCTACTCCACCCCTTACTCCTT<br>CGGCCAAGGAACCAGGCTGGAAATCAAG |
| BCMA_EBB-01978-D10-aa VH | 183 | EVQLVETGGGLVQPGRSLRLSCAASGFTFDDYAMHWVRQAPGKGLEWVSGISW<br>NSGSIGYADSVKGRFTISRDNAKNSLYLQMNSLRDEDTAVYYCARVGKAVPDV<br>WGQGTTVTVSS |
| BCMA_EBB-C1978-D10-aa VL | 204 | DIVMTQTPSSLSASVGDRVTITCRASQSISSYLNWYQQKPGKAPKLLIYAASS<br>LQSGVPSRFSGSGSGTDFTLTISSLQPEDFATYYCQQSYSTPYSFGQGTRLEI<br>K |
| BCMA_EBB-01978-D10-aa Full CART | 225 | MALPVTALLLPLALLLHAARPEVQLVETGGGLVQPGRSLRLSCAASGFTFDDY<br>AMHWVRQAPGKGLEWVSGISWNSGSIGYADSVKGRFTISRDNAKNSLYLQMNS<br>LRDEDTAVYYCARVGKAVPDVWGQGTTVTVSSGGGGSGGGGSGGGGSDIVMTQ<br>TPSSLSASVGDRVTITCRASQSISSYLNWYQQKPGKAPKLLIYAASSLQSGVP<br>SRFSGSGSGTDFTLTISSLQPEDFATYYCQQSYSTPYSFGQGTRLEIKTTTPA<br>PRPPTPAPTIASQPLSLRPEACRPAAGGAVHTRGLDFACDIYIWAPLAGTCGV<br>LLLSLVITLYCKRGRKKLLYIFKQPFMRPVQTTQEEDGCSCRFPEEEEGGCEL<br>RVKFSRSADAPAYKQGQNQLYNELNLGRREEYDVLDKRRGRDPEMGGKPRRKN<br>PQEGLYNELQKDKMAEAYSEIGMKGERRRGKGHDGLYQGLSTATKDTYDALHM<br>QALPPR |
| BCMA_EBB-C1978-D10-nt Full CART | 246 | ATGGCCCTCCCTGTCACCGCCCTGCTGCTTCCGCTGGCTCTTCTGCTCCACGC<br>CGCTCGGCCCGAAGTGCAGCTCGTGGAAACTGGAGGTGGACTCGTGCAGCCTG<br>GACGGTCGCTGCGGCTGAGCTGCGCTGCATCCGGCTTCACCTTCGACGATTAT<br>GCCATGCACTGGGTCAGACAGGCGCCAGGGAAGGGACTTGAGTGGGTGTCCGG<br>TATCAGCTGGAATAGCGGCTCAATCGGATACGCGGACTCCGTGAAGGGAAGGT<br>TCACCATTTCCCGCGACAACGCCAAGAACTCCCTGTACTTGCAAATGAACAGC<br>CTCCGGGATGAGGACACTGCCGTGTACTACTGCGCCCGCGTCGGAAAAGCTGT<br>GCCCGACGTCTGGGGCCAGGGAACCACTGTGACCGTGTCCAGCGGCGGGGGTG<br>GATCGGGCGGTGGAGGGTCCGGTGGAGGGGGCTCAGATATTGTGATGACCCAG<br>ACCCCCTCGTCCCTGTCCGCCTCGGTCGGCGACCGCGTGACTATCACATGTAG<br>AGCCTCGCAGAGCATCTCCAGCTACCTGAACTGGTATCAGCAGAAGCCGGGGA<br>AGGCCCCGAAGCTCCTGATCTACGCGGCATCATCACTGCAATCGGGAGTGCCG<br>AGCCGGTTTTCCGGGTCCGGCTCCGGCACCGACTTCACGCTGACCATTTCTTC<br>CCTGCAACCCGAGGACTTCGCCACTTACTACTGCCAGCAGTCCTACTCCACCC<br>CTTACTCCTTCGGCCAAGGAACCAGGCTGGAAATCAAGACCACTACCCCAGCA<br>CCGAGGCCACCCACCCCGGCTCCTACCATCGCCTCCCAGCCTCTGTCCCTGCG<br>TCCGGAGGCATGTAGACCCGCAGCTGGTGGGCCGTGCATACCCGGGTCTTG<br>ACTTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAGCT<br>GCTGTACATCTTTAAGCAACCCTTCATGAGGCCTGTGCAGACTACTCAAGAGG<br>AGGACGGCTGTTCATGCCGGTTCCCAGAGGAGGAGGAAGGCGGCTGCGAACTG<br>CGCGTGAAATTCAGCCGCAGCGCAGATGCTCCAGCCTACAAGCAGGGGCAGAA<br>CCAGCTCTACAACGAACTCAATCTTGGTCGGAGAGAGGAGTACGACGTGCTGG<br>ACAAGCGGAGAGGACGGGACCCAGAAATGGGCGGGAAGCCGCGCAGAAAGAAT<br>CCCCAAGAGGGCCTGTACAACGAGCTCCAAAAGGATAAGATGGCAGAAGCCTA<br>TAGCGAGATTGGTATGAAAGGGGAACGCAGAAGAGGCAAAGGCCACGACGGAC<br>TGTACCAGGGACTCAGCACCGCCACCAAGGACACCTATGACGCTCTTCACATG<br>CAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| BCMA_EBB-C1979-C12 | | |
| BCMA_EBB-C1979-C12-aa ScFv domain | 142 | EVQLVESGGGLVQPGRSLRLSCTASGFTFDDYAMHWVRQRPGKGLEWVASINW KGNSLAYGDSVKGRFAISRDNAKNTVFLQMNSLRTEDTAVYYCASHQGVAYYN YAMDVWGRGTLVTVSSGGGGSGGGGSGGGGSEIVLTQSPGTLSLSPGERATLS CRATQSIGSSFLAWYQQRPGQAPRLLIYGASQRATGIPDRFSGRGSGTDFTLT ISRVEPEDSAVYYCQHYESSPSWTFGQGTKVEIK |
| BCMA_EBB-C1979-C12 - nt ScFv domain | 163 | GAAGTGCAGCTCGTGGAGAGCGGGGGAGGATTGGTGCAGCCCGGAAGGTCCCT GCGGCTCTCCTGCACTGCGTCTGGCTTCACCTTCGACGACTACGCGATGCACT GGGTCAGACAGCGCCCGGGAAAGGGCCTGGAATGGGTCGCCTCAATCAACTGG AAGGGAAACTCCCTGGCCTATGGCGACAGCGTGAAGGGCCGCTTCGCCATTTC GCGCGACAACGCCAAGAACACCGTGTTTCTGCAAATGAATTCCCTGCGGACCG AGGATACCGCTGTGTACTACTGCGCCAGCCACCAGGGCGTGGCATACTATAAC TACGCCATGGACGTGTGGGGAAGAGGGACGCTCGTCACCGTGTCCTCCGGGGG CGGTGGATCGGGTGGAGGAGGAAGCGGTGGCGGGGGCAGCGAAATCGTGCTGA CTCAGAGCCCGGGAACTCTTTCACTGTCCCCGGGAGAACGGGCCACTCTCTCG TGCCGGGCCACCCAGTCCATCGGCTCCTCCTTCCTTGCCTGGTACCAGCAGAG GCCAGGACAGGCGCCCGCCTGCTGATCTACGGTGCTTCCCAACGCGCCACTG GCATTCCTGACCGGTTCAGCGGCAGAGGGTCGGGAACCGATTTCACACTGACC ATTTCCCGGGTGGAGCCCGAAGATTCGGCAGTCTACTACTGTCAGCATTACGA GTCCTCCCCTTCATGGACCTTCGGTCAAGGGACCAAAGTGGAGATCAAG |
| BCMA_EBB-C1979-C12 - aa VH | 184 | EVQLVESGGGLVQPGRSLRLSCTASGFTFDDYAMHWVRQRPGKGLEWVASINW KGNSLAYGDSVKGRFAISRDNAKNTVFLQMNSLRTEDTAVYYCASHQGVAYYN YAMDVWGRGTLVTVSS |
| BCMA_EBB-C1979-C12 - aa VL | 205 | EIVLTQSPGTLSLSPGERATLSCRATQSIGSSFLAWYQQRPGQAPRLLIYGAS QRATGIPDRFSGRGSGTDFTLTISRVEPEDSAVYYCQHYESSPSWTFGQGTKV EIK |
| BCMA_EBB-C1979-C12 - aa Full CART | 226 | MALPVTALLLPLALLLHAARPEVQLVESGGGLVQPGRSLRLSCTASGFTFDDY AMHWVRQRPGKGLEWVASINWKGNSLAYGDSVKGRFAISRDNAKNTVFLQMNS LRTEDTAVYYCASHQGVAYYNYAMDVWGRGTLVTVSSGGGGSGGGGSGGGGSE IVLTQSPGTLSLSPGERATLSCRATQSIGSSFLAWYQQRPGQAPRLLIYGASQ RATGIPDRFSGRGSGTDFTLTISRVEPEDSAVYYCQHYESSPSWTFGQGTKVE IKTTTPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCRFPEE EEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKD TYDALHMQALPPR |
| BCMA_EBB-C1979-C12 - nt Full CART | 247 | ATGGCCCTCCCTGTCACCGCCCTGCTGCTTCCGCTGGCTCTTCTGCTCCACGC CGCTCGGCCCGAAGTGCAGCTCGTGGAGAGCGGGGGAGGATTGGTGCAGCCCG GAAGGTCCCTGCGGCTCTCCTGCACTGCGTCTGGCTTCACCTTCGACGACTAC GCGATGCACTGGGTCAGACAGCGCCCGGGAAAGGGCCTGGAATGGGTCGCCTC AATCAACTGGAAGGGAAACTCCCTGGCCTATGGCGACAGCGTGAAGGGCCGCT TCGCCATTTCGCGCGACAACGCCAAGAACACCGTGTTTCTGCAAATGAATTCC CTGCGGACCGAGGATACCGCTGTGTACTACTGCGCCAGCCACCAGGGCGTGGC ATACTATAACTACGCCATGGACGTGTGGGGAAGAGGGACGCTCGTCACCGTGT CCTCCGGGGGCGGTGGATCGGGTGGAGGAGGAAGCGGTGGCGGGGGCAGCGAA ATCGTGCTGACTCAGAGCCCGGGAACTCTTTCACTGTCCCCGGGAGAACGGGC CACTCTCTCGTGCCGGGCCACCCAGTCCATCGGCTCCTCCTTCCTTGCCTGGT ACCAGCAGAGGCCAGGACAGGCGCCCGCCTGCTGATCTACGGTGCTTCCCAA CGCGCCACTGGCATTCCTGACCGGTTCAGCGGCAGAGGGTCGGGAACCGATTT CACACTGACCATTTCCCGGGTGGAGCCCGAAGATTCGGCAGTCTACTACTGTC AGCATTACGAGTCCTCCCCTTCATGGACCTTCGGTCAAGGGACCAAAGTGGAG ATCAAGACCACTACCCCAGCACCGAGGCCACCCACCCCGGCTCCTACCATCGC CTCCCAGCCTCTGTCCCTGCGTCCGGAGGCATGTAGACCCGCAGCTGGTGGGG CCGTGCATACCCGGGGTCTTGACTTCGCCTGCGATATCTACATTTGGGCCCCT CTGGCTGGTACTTGCGGGGTCCTGCTGCTTTCACTCGTGATCACTCTTTACTG TAAGCGCGGTCGGAAGAAGCTGCTGTACATCTTTAAGCAACCCTTCATGAGGC CTGTGCAGACTACTCAAGAGGAGGACGGCTGTTCATGCCGGTTCCCAGAGGAG GAGGAAGGCGGCTGCGAACTGCGCGTGAAATTCAGCCGCAGCGCAGATGCTCC AGCCTACAAGCAGGGGCAGAACCAGCTCTACAACGAACTCAATCTTGGTCGGA GAGAGGAGTACGACGTGCTGGACAAGCGGAGAGGACGGGACCCAGAAATGGGC GGGAAGCCGCGCAGAAAGAATCCCCAAGAGGGCCTGTACAACGAGCTCCAAAA GGATAAGATGGCAGAAGCCTATAGCGAGATTGGTATGAAGGGGAACGCAGAA GAGGCAAAGGCCACGACGGACTGTACCAGGGACTCAGCACCGCCACCAAGGAC ACCTATGACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| BCMA_EBB-C1980-G4 | | |
| BCMA_EBB-C1980-G4- aa ScFv domain | 143 | EVQLVESGGGLVQPGGSLRLSCAASGFTFSSYAMSWVRQAPGKGLEW VSAISGSGGSTYYADSVKGRFTISRDNSKNTLYLQMNSLRAEDTAVYY CAKVVRDGMDVWGQGTTVTVSSGGGGSGGGGSGGGGSEIVLTQSPA TLSLSPGERATLSCRASQSVSSSYLAWYQQKPGQAPRLLIYGASSRATG IPDRFSGNGSGTDFTLTISRLEPEDFAVYYCQQYGSPPRFTFGPGTKVDI K |
| BCMA_EBB-C1980-G4- nt ScFv domain | 164 | GAGGTGCAGTTGGTCGAAAGCGGGGGCGGGCTTGTGCAGCCTGGCGGATCACT GCGGCTGTCCTGCGCGGCATCAGGCTTCACGTTTTCTTCCTACGCCATGTCCT GGGTGCGCCAGGCCCCTGGAAAGGGACTGGAATGGGTGTCCGCGATTTCGGGG TCCGGCGGGAGCACCTACTACGCCGATTCCGTGAAGGGCCGCTTCACTATCTC GCGGGACAACTCCAAGAACACCCTCTACCTCCAAATGAATAGCCTGCGGGCCG AGGATACCGCCGTCTACTATTGCGCTAAGGTCGTGCGCGACGGAATGGACGTG TGGGGACAGGGTACCACCGTGACAGTGTCCTCGGGGGGAGGCGGTAGCGGCGG AGGAGGAAGCGGTGGTGGAGGTTCCGAGATTGTGCTGACTCAATCACCCGCGA CCCTGAGCCTGTCCCCGGCGAAAGGGCCACTCTGTCCTGTCGGGCCAGCCAA TCAGTCTCCTCCTCGTACCTGGCCTGGTACCAGCAGAAGCCAGGACAGGCTCC GAGACTCCTTATCTATGGCGCATCCTCCCGCGCCACCGGAATCCCGGATAGGT TCTCGGGAAACGGATCGGGGACCGACTTCACTCTCACCATCTCCCGGCTGGAA CCGGAGGACTTCGCCGTGTACTACTGCCAGCAGTACGGCAGCCCGCCTAGATT CACTTTCGGCCCCGGCACCAAAGTGGACATCAAG |
| BCMA_EBB-C1980-G4- aa VH | 185 | EVQLVESGGGLVQPGGSLRLSCAASGFTFSSYAMSWVRQAPGKGLEWVSAISG SGGSTYYADSVKGRFTISRDNSKNTLYLQMNSLRAEDTAVYYCAKVVRDGMDV WGQGTTVTVSS |
| BCMA_EBB-C1980-G4- aa VL | 206 | EIVLTQSPATLSLSPGERATLSCRASQSVSSSYLAWYQQKPGQAPRLLIYGAS SRATGIPDRFSGNGSGTDFTLTISRLEPEDFAVYYCQQYGSPPRFTFGPGTKV DIK |
| BCMA_EBB-C1980-G4- aa Full CART | 227 | MALPVTALLLPLALLLHAARPEVQLVESGGGLVQPGGSLRLSCAASGF TFSSYAMSWVRQAPGKGLEWVSAISGSGGSTYYADSVKGRFTISRDNS KNTLYLQMNSLRAEDTAVYYCAKVVRDGMDVWGQGTTVTVSSGGG GSGGGGSGGGGSEIVLTQSPATLSLSPGERATLSCRASQSVSSSYLAWY QQKPGQAPRLLIYGASSRATGIPDRFSGNGSGTDFTLTISRLEPEDFAVY YCQQYGSPPRFTFGPGTKVDIKTTTPAPRPPTPAPTIASQPLSLRPEACRP AAGGAVHTRGLDFACDIYIWAPLAGTCGVLLLSLVITLYCKRGRKKLL YIFKQPFMRPVQTTQEEDGCSCRFPEEEEGGCELRVKFSRSADAPAYK QGQNQLYNELNLGRREEYDVLDKRRGRDPEMGGKPRRKNPQEGLYN ELQKDKMAEAYSEIGMKGERRRGKGHDGLYQGLSTATKDTYDALHM QALPPR |
| BCMA_EBB-C1980-G4- nt Full CART | 248 | ATGGCCCTCCCTGTCACCGCCCTGCTGCTTCCGCTGGCTCTTCTGCTCCACGC CGCTCGGCCCGAGGTGCAGTTGGTCGAAAGCGGGGGCGGGCTTGTGCAGCCTG GCGGATCACTGCGGCTGTCCTGCGCGGCATCAGGCTTCACGTTTTCTTCCTAC GCCATGTCCTGGGTGCGCCAGGCCCCTGGAAAGGGACTGGAATGGGTGTCCGC GATTTCGGGGTCCGGCGGGAGCACCTACTACGCCGATTCCGTGAAGGGCCGCT TCACTATCTCGCGGGACAACTCCAAGAACACCCTCTACCTCCAAATGAATAGC CTGCGGGCCGAGGATACCGCCGTCTACTATTGCGCTAAGGTCGTGCGCGACGG AATGGACGTGTGGGGACAGGGTACCACCGTGACAGTGTCCTCGGGGGGAGGCG GTAGCGGCGGAGGAGGAAGCGGTGGTGGAGGTTCCGAGATTGTGCTGACTCAA TCACCCGCGACCCTGAGCCTGTCCCCGGCGAAAGGGCCACTCTGTCCTGTCG GGCCAGCCAATCAGTCTCCTCCTCGTACCTGGCCTGGTACCAGCAGAAGCCAG GACAGGCTCCGAGACTCCTTATCTATGGCGCATCCTCCCGCGCCACCGGAATC CCGGATAGGTTCTCGGGAAACGGATCGGGGACCGACTTCACTCTCACCATCTC CCGGCTGGAACCGGAGGACTTCGCCGTGTACTACTGCCAGCAGTACGGCAGCC CGCCTAGATTCACTTTCGGCCCCGGCACCAAAGTGGACATCAAGACCACTACC CCAGCACCGAGGCCACCCACCCCGGCTCCTACCATCGCCTCCCAGCCTCTGTC CCTGCGTCCGGAGGCATGTAGACCCGCAGCTGGTGGGCCGTGCATACCCGGG GTCTTGACTTCGCCTGCGATATCTACATTTGGGCCCCTCTGCTGGTACTTGC GGGGTCCTGCTGCTTTCACTCGTGATCACTCTTTACTGTAAGCGCGGTCGGAA GAAGCTGCTGTACATCTTTAAGCAACCCTTCATGAGGCCTGTGCAGACTACTC AAGAGGAGGACGGCTGTTCATGCCGGTTCCCAGAGGAGGAGGAAGGCGGCTGC GAACTGCGCGTGAAATTCAGCCGCAGCGCAGATGCTCCAGCCTACAAGCAGGG GCAGAACCAGCTCTACAACGAACTCAATCTTGGTCGGAGAGAGGAGTACGACG TGCTGGACAAGCGGAGAGGACGGGACCCAGAAATGGGCGGGAAGCCGCGCAGA AAGAATCCCAAGAGGGCCTGTACAACGAGCTCCAAAAGGATAAGATGGCAGA AGCCTATAGCGAGATTGGTATGAAAGGGGAACGCAGAAGAGGCAAAGGCCACG ACGGACTGTACCAGGGACTCAGCACCGCCACCAAGGACACCTATGACGCTCTT CACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| BCMA_EBB-C1980-D2 | | |
| BCMA_EBB-C1980-D2- aa ScFv domain | 144 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCAKIPQTGTFD YWGQGTLVTVSSGGGGSGGGGSGGGGSEIVLTQSPGTLSLSPGERATLSCRAS QSVSSSYLAWYQQRPGQAPRLLIYGASSRATGIPDRFSGSGSGTDFTLTISRL EPEDFAVYYCQHYGSSPSWTFGQGTRLEIK |
| BCMA_EBB-C1980-D2- nt ScFv domain | 165 | GAAGTGCAGCTGCTGGAGTCCGGCGGTGGATTGGTGCAACCGGGGGGATCGCT CAGACTGTCCTGTGCGGCGTCAGGCTTCACCTTCTCGAGCTACGCCATGTCAT GGGTCAGACAGGCCCCTGGAAAGGGTCTGGAATGGGTGTCCGCCATTTCCGGG AGCGGGGGATCTACATACTACGCCGATAGCGTGAAGGGCCGCTTCACCATTTC CCGGGACAACTCCAAGAACACTCTCTATCTGCAAATGAACTCCCTCCGCGCTG AGGACACTGCCGTGTACTACTGCGCCAAAATCCCTCAGACCGGCACCTTCGAC TACTGGGGACAGGGGACTCTGGTCACCGTCAGCAGCGGTGGCGGAGGTTCGGG GGGAGGAGGAAGCGGCGGCGGAGGGTCCGAGATTGTGCTGACCCAGTCACCCG GCACTTTGTCCCTGTCGCCTGGAGAAAGGGCCACCCTTTCCTGCCGGGCATCC CAATCCGTGTCCTCCTCGTACCTGGCCTGGTACCAGCAGAGGCCCGGACAGGC CCCACGGCTTCTGATCTACGGAGCAAGCAGCCGCGCGACCGGTATCCCGGACC GGTTTTCGGGCTCGGGCTCAGGAACTGACTTCACCCTCACCATCTCCCGCCTG GAACCCGAAGATTTCGCTGTGTATTACTGCCAGCACTACGGCAGCTCCCCGTC CTGGACGTTCGGCCAGGGAACTCGGCTGGAGATCAAG |
| BCMA_EBB-C1980-D2- aa VH | 186 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCAKIPQTGTFD YWGQGTLVTVSS |
| BCMA_EBB-C1980-D2- aa VL | 207 | EIVLTQSPGTLSLSPGERATLSCRASQSVSSSYLAWYQQRPGQAPRLLIYGAS SRATGIPDRFSGSGSGTDFTLTISRLEPEDFAVYYCQHYGSSPSWTFGQGTRL EIK |
| BCMA_EBB-C1980-D2- aa Full CART | 228 | MALPVTALLLPLALLLHAARPEVQLLESGGGLVQPGGSLRLSCAASGFTFSSY AMSWVRQAPGKGLEWVSAISGSGGSTYYADSVKGRFTISRDNSKNTLYLQMNS LRAEDTAVYYCAKIPQTGTFDYWGQGTLVTVSSGGGGSGGGGSGGGGSEIVLT QSPGTLSLSPGERATLSCRASQSVSSSYLAWYQQRPGQAPRLLIYGASSRATG IPDRFSGSGSGTDFTLTISRLEPEDFAVYYCQHYGSSPSWTFGQGTRLEIKTT TPAPRPPTPAPTIASQPLSLRPEACRPAAGGAVHTRGLDFACDIYIWAPLAGT CGVLLLSLVITLYCKRGRKKLLYIFKQPFMRPVQTTQEEDGCSCRFPEEEEGG CELRVKFSRSADAPAYKQGQNQLYNELNLGRREEYDVLDKRRGRDPEMGGKPR RKNPQEGLYNELQKDKMAEAYSEIGMKGERRRGKGHDGLYQGLSTATKDTYDA LHMQALPPR |
| BCMA_EBB-C1980-D2- nt Full CART | 249 | ATGGCCCTCCCTGTCACCGCCCTGCTGCTTCCGCTGGCTCTTCTGCTCCACGC CGCTCGGCCCGAAGTGCAGCTGCTGGAGTCCGGCGGTGGATTGGTGCAACCGG GGGGATCGCTCAGACTGTCCTGTGCGGCGTCAGGCTTCACCTTCTCGAGCTAC GCCATGTCATGGGTCAGACAGGCCCCTGGAAAGGGTCTGGAATGGGTGTCCGC CATTTCCGGGAGCGGGGGATCTACATACTACGCCGATAGCGTGAAGGGCCGCT TCACCATTTCCCGGGACAACTCCAAGAACACTCTCTATCTGCAAATGAACTCC CTCCGCGCTGAGGACACTGCCGTGTACTACTGCGCCAAAATCCCTCAGACCGG CACCTTCGACTACTGGGGACAGGGGACTCTGGTCACCGTCAGCAGCGGTGGCG GAGGTTCGGGGGGAGGAGGAAGCGGCGGCGGAGGGTCCGAGATTGTGCTGACC CAGTCACCCGGCACTTTGTCCCTGTCGCCTGGAGAAAGGGCCACCCTTTCCTG CCGGGCATCCCAATCCGTGTCCTCCTCGTACCTGGCCTGGTACCAGCAGAGGC CCGGACAGGCCCCACGGCTTCTGATCTACGGAGCAAGCAGCCGCGCGACCGGT ATCCCGGACCGGTTTTCGGGCTCGGGCTCAGGAACTGACTTCACCCTCACCAT CTCCCGCCTGGAACCCGAAGATTTCGCTGTGTATTACTGCCAGCACTACGGCA GCTCCCCGTCCTGGACGTTCGGCCAGGGAACTCGGCTGGAGATCAAGACCACT ACCCCAGCACCGAGGCCACCCACCCCGGCTCCTACCATCGCCTCCCAGCCTCT GTCCCTGCGCTCCGGAGGCATGTAGACCCGCAGCTGGTGGGCCGTGCATACCC GGGGTCTTGACTTCGCCTGCGATATCTACATTTGGGCCCCTCTGGCTGGTACT TGCGGGGTCCTGCTGCTTTCACTCGTGATCACTCTTTACTGTAAGCGCGGTCG GAAGAAGCTGCTGTACATCTTTAAGCAACCCTTCATGAGGCCTGTGCAGACTA CTCAAGAGGAGGACGGCTGTTCATGCCGGTTCCCAGAGGAGGAGGAAGGCGGC TGCGAACTGCGCGTGAAATTCAGCCGCAGCGCAGATGCTCCAGCCTACAAGCA GGGGCAGAACCAGCTCTACAACGAACTCAATCTTGGTCGGAGAGAGGAGTACG ACGTGCTGGACAAGCGGAGAGGACGGGACCCAGAAATGGGCGGGAAGCCGCGC AGAAAGAATCCCCAAGAGGGCCTGTACAACGAGCTCCAAAAGGATAAGATGGC AGAAGCCTATAGCGAGATTGGTATGAAGGGGAACGCAGAAGAGGCAAAGGCC ACGACGGACTGTACCAGGGACTCAGCACCGCCACCAAGGACACCTATGACGCT CTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | BCMA_EBB-C1978-A10 |
| BCMA_EBB-<br>C1978-A10-<br>aa<br>ScFv domain | 145 | EVQLVETGGGLVQPGGSLRLSCAASGFTFSSYAMSWVRQAPGKGLEW<br>VSAISGSGGSTYYADSVKGRFTMSRENDKNSVFLQMNSLRVEDTGVY<br>YCARANYKRELRYYYGMDVWGQGTMVTVSSGGGGSGGGGSGGGGS<br>EIVMTQSPGTLSLSPGESATLSCRASQRVASNYLAWYQHKPGQAPSLLI<br>SGASSRATGVPDRFSGSGSGTDFTLAISRLEPEDSAVYYCQHYDSSPSW<br>TFGQGTKVEIK |
| BCMA_EBB-<br>C1978-A10-<br>nt<br>ScFv domain | 166 | GAAGTGCAACTGGTGGAAACCGGTGGAGGACTCGTGCAGCCTGGCGGCAGCCT<br>CCCGGCTGAGCTGCGCCGCTTCGGGATTCACCTTTTCCTCCTACGCGATGTCTT<br>GGGTCAGACAGGCCCCCGGAAAGGGGCTGGAATGGGTGTCAGCCATCTCCGGC<br>TCCGGCGGATCAACGTACTACGCCGACTCCGTGAAAGGCCGGTTCACCATGTC<br>GCGCGAGAATGACAAGAACTCCGTGTTCCTGCAAATGAACTCCCTGAGGGTGG<br>AGGACACCGGAGTGTACTATTGTGCGCGCGCCAACTACAAGAGAGAGCTGCGG<br>TACTACTACGGAATGGACGTCTGGGGACAGGGAACTATGGTGACCGTGTCATC<br>CGGTGGAGGGGGAAGCGGCGGTGGAGGCAGCGGGGGCGGGGGTTCAGAAATTG<br>TCATGACCCAGTCCCCGGGAACTCTTTCCCTCTCCCCGGGGAATCCGCGACT<br>TTGTCCTGCCGGGCCAGCCAGCGCGTGGCCTCGAACTACCTCGCATGGTACCA<br>GCATAAGCCAGGCCAAGCCCCTTCCCTGCTGATTTCCGGGGCTAGCAGCCGCG<br>CCACTGGCGTGCCGGATAGGTTCTCGGGAAGCGGCTCGGGTACCGATTTCACC<br>CTGGCAATCTCGCGGCTGGAACCGGAGGATTCGGCCGTGTACTACTGCCAGCA<br>CTATGACTCATCCCCCTCCTGGACATTCGGACAGGGCACCAAGGTCGAGATCA<br>AG |
| BCMA_EBB-<br>C1978-A10-<br>aa<br>VH | 187 | EVQLVETGGGLVQPGGSLRLSCAASGFTFSSYAMSWVRQAPGKGLEWVSAISG<br>SGGSTYYADSVKGRFTMSRENDKNSVFLQMNSLRVEDTGVYYCARANYKRELR<br>YYYGMDVWGQGTMVTVSS |
| BCMA_EBB-<br>C1978-A10-<br>aa<br>VL | 208 | EIVMTQSPGTLSLSPGESATLSCRASQRVASNYLAWYQHKPGQAPSLLISGAS<br>SRATGVPDRFSGSGSGTDFTLAISRLEPEDSAVYYCQHYDSSPSWTFGQGTKV<br>EIK |
| BCMA_EBB-<br>C1978-A10-<br>aa<br>Full CART | 229 | MALPVTALLLPLALLLHAARPEVQLVETGGGLVQPGGSLRLSCAASGF<br>TFSSYAMSWVRQAPGKGLEWVSAISGSGGSTYYADSVKGRFTMSREN<br>DKNSVFLQMNSLRVEDTGVYYCARANYKRELRYYYGMDVWGQGTM<br>VTVSSGGGGSGGGGSGGGGSEIVMTQSPGTLSLSPGESATLSCRASQR<br>VASNYLAWYQHKPGQAPSLLISGASSRATGVPDRFSGSGSGTDFTLAIS<br>RLEPEDSAVYYCQHYDSSPSWTFGQGTKVEIKTTTPAPRPPTPAPTIAS<br>QPLSLRPEACRPAAGGAVHTRGLDFACDIYIWAPLAGTCGVLLLSLVIT<br>LYCKRGRKKLLYIFKQPFMRPVQTTQEEDGCSCRFPEEEEGGCELRVK<br>FSRSADAPAYKQGQNQLYNELNLGRREEYDVLDKRRGRDPEMGGKP<br>RRKNPQEGLYNELQKDKMAEAYSEIGMKGERRRGKGHDGLYQGLST<br>ATKDTYDALHMQALPPR |
| BCMA_EBB-<br>C1978-A10-<br>nt<br>Full CART | 250 | ATGGCCCTCCCTGTCACCGCCCTGCTGCTTCCGCTGGCTCTTCTGCTCCACGC<br>CGCTCGGCCCGAAGTGCAACTGGTGGAAACCGGTGGAGGACTCGTGCAGCCTG<br>GCGGCAGCCTCCCGGCTGAGCTGCGCCGCTTCGGGATTCACCTTTTCCTCCTAC<br>GCGATGTCTTGGGTCAGACAGGCCCCCGGAAAGGGGCTGGAATGGGTGTCAGC<br>CATCTCCGGCTCCGGCGGATCAACGTACTACGCCGACTCCGTGAAAGGCCGGT<br>TCACCATGTCGCGCGAGAATGACAAGAACTCCGTGTTCCTGCAAATGAACTCC<br>CTGAGGGTGGAGGACACCGGAGTGTACTATTGTGCGCGCGCCAACTACAAGAG<br>AGAGCTGCGGTACTACTACGGAATGGACGTCTGGGGACAGGGAACTATGGTGA<br>CCGTGTCATCCGGTGGAGGGGGAAGCGGCGGTGGAGGCAGCGGGGGCGGGGGT<br>TCAGAAATTGTCATGACCCAGTCCCCGGGAACTCTTTCCCTCTCCCCGGGGA<br>ATCCGCGACTTTGTCCTGCCGGGCCAGCCAGCGCGTGGCCTCGAACTACCTCG<br>CATGGTACCAGCATAAGCCAGGCCAAGCCCCTTCCCTGCTGATTTCCGGGGCT<br>AGCAGCCGCGCCACTGGCGTGCCGGATAGGTTCTCGGGAAGCGGCTCGGGTAC<br>CGATTTCACCCTGGCAATCTCGCGGCTGGAACCGGAGGATTCGGCCGTGTACT<br>ACTGCCAGCACTATGACTCATCCCCCTCCTGGACATTCGGACAGGGCACCAAG<br>GTCGAGATCAAGACCACTACCCCAGCACCGAGGCCACCCACCCCGGCTCCTAC<br>CATCGCCTCCCAGCCTCTGTCCCTGCGTCCGAGGCATGTAGACCCGCAGCTG<br>GTGGGGCCGTGCATACCCGGGGTCTTGACTTCGCCTGCGATATCTACATTTGG<br>GCCCCTCTGGCTGGTACTTGCGGGGTCCTGCTGCTTTCACTCGTGATCACTCT<br>TTACTGTAAGCGCGGTCGGAAGAAGCTGCTGTACATCTTTAAGCAACCCTTCA<br>TGAGGCCTGTGCAGACTACTCAAGAGGAGGACGGCTGTTCATGCCGGTTCCCA<br>GAGGAGGAGGAAGGCGGCTGCGAACTGCGCGTGAAATTCAGCCGCAGCGCAGA<br>TGCTCCAGCCTACAAGCAGGGGCAGAACCAGCTCTACAACGAACTCAATCTTG<br>GTCGAGAGAGGAGTACGACGTGCTGGACAAGCGGAGGACGGGACCCAGAA<br>ATGGGCGGGAAGCCGCGCAGAAAGAATCCCCAAGAGGGCCTGTACAACGAGCT<br>CCAAAAGGATAAGATGGCAGAAGCCTATAGCGAGATTGGTATGAAAGGGGAAC<br>GCAGAAGAGGCAAAGGCCACGACGGACTGTACCAGGGACTCAGCACCGCCACC<br>AAGGACACCTATGACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
| --- | --- | --- |
| | | BCMA_EBB-C1978-D4 |
| BCMA_EBB-<br>C1978-D4- aa<br>ScFv domain | 146 | EVQLLETGGGLVQPGGSLRLSCAASGFSFSSYAMSWVRQAPGKGLEWVSAISG<br>SGGSTYYADSVKGRFTISRDNSKNTLYLQMNSLRAEDTAVYYCAKALVGATGA<br>FDIWGQGTLVTVSSGGGGSGGGGSGGGGSEIVLTQSPGTLSLSPGERATLSCR<br>ASQSLSSNFLAWYQQKPGQAPGLLIYGASNWATGTPDRFSGSGSGTDFTLTIT<br>RLEPEDFAVYYCQYYGTSPMYTFGQGTKVEIK |
| BCMA_EBB-<br>C1978-D4- nt<br>ScFv domain | 167 | GAAGTGCAGCTGCTCGAAACCGGTGGAGGGCTGGTGCAGCCAGGGGGCTCCCT<br>GAGGCTTTCATGCGCCGCTAGCGGATTCTCCTTCTCCTCTTACGCCATGTCGT<br>GGGTCCGCCAAGCCCCTGGAAAAGGCCTGGAATGGGTGTCCGCGATTTCCGGG<br>AGCGGAGGTTCGACCTATTACGCCGACTCCGTGAAGGGCCGCTTTACCATCTC<br>CCGGGATAACTCCAAGAACACTCTGTACCTCCAAATGAACTCGCTGAGAGCCG<br>AGGACACCGCCGTGTATTACTGCGCGAAGGCGCTGGTCGGCGCGACTGGGGCA<br>TTCGACATCTGGGGACAGGGAACTCTTGTGACCGTGTCGAGCGGAGGCGGCGG<br>CTCCGGCGGAGGAGGGAGCGGGGGCGGTGGTTCCGAAATCGTGTTGACTCAGT<br>CCCCGGGAACCCTGAGCTTGTCACCCGGGGAGCGGGCCACTCTCTCCTGTCGC<br>GCCTCCCAATCGCTCTCATCCAATTTCCTGGCCTGGTACCAGCAGAAGCCCGG<br>ACAGGCCCCGGGCCTGCTCATCTACGGCGCTTCAAACTGGGCAACGGGAACCC<br>CTGATCGGTTCAGCGGAAGCGGATCGGGTACTGACTTTACCCTGACCATCACC<br>AGACTGGAACCGGAGGACTTCGCCGTGTACTACTGCCAGTACTACGGCACCTC<br>CCCCATGTACACATTCGGACAGGGTACCAAGGTCGAGATTAAG |
| BCMA_EBB-<br>C1978-D4- aa<br>VH | 188 | EVQLLETGGGLVQPGGSLRLSCAASGFSFSSYAMSWVRQAPGKGLEWVSAISG<br>SGGSTYYADSVKGRFTISRDNSKNTLYLQMNSLRAEDTAVYYCAKALVGATGA<br>FDIWGQGTLVTVSS |
| BCMA_EBB-<br>C1978-D4- aa<br>VL | 209 | EIVLTQSPGTLSLSPGERATLSCRASQSLSSNFLAWYQQKPGQAPGLLIYGAS<br>NWATGTPDRFSGSGSGTDFTLTITRLEPEDFAVYYCQYYGTSPMYTFGQGTKV<br>EIK |
| BCMA_EBB-<br>C1978-D4- aa<br>Full CART | 230 | MALPVTALLLPLALLLHAARPEVQLLETGGGLVQPGGSLRLSCAASGFSFSSY<br>AMSWVRQAPGKGLEWVSAISGSGGSTYYADSVKGRFTISRDNSKNTLYLQMNS<br>LRAEDTAVYYCAKALVGATGAFDIWGQGTLVTVSSGGGGSGGGGSGGGGSEIV<br>LTQSPGTLSLSPGERATLSCRASQSLSSNFLAWYQQKPGQAPGLLIYGASNWA<br>TGTPDRFSGSGSGTDFTLTITRLEPEDFAVYYCQYYGTSPMYTFGQGTKVEIK<br>TTTPAPRPPTPAPTIASQPLSLRPEACRPAAGGAVHTRGLDFACDIYIWAPLA<br>GTCGVLLLSLVITLYCKRGRKKLLYIFKQPFMRPVQTTQEEDGCSCRFPEEEE<br>GGCELRVKFSRSADAPAYKQGQNQLYNELNLGRREEYDVLDKRRGRDPEMGGK<br>PRRKNPQEGLYNELQKDKMAEAYSEIGMKGERRRGKGHDGLYQGLSTATKDTY<br>DALHMQALPPR |
| BCMA_EBB-<br>C1978-D4- nt<br>Full CART | 251 | ATGGCCCTCCCTGTCACCGCCCTGCTGCTTCCGCTGGCTCTTCTGCTCCACGC<br>CGCTCGGCCCGAAGTGCAGCTGCTCGAAACCGGTGGAGGGCTGGTGCAGCCAG<br>GGGGCTCCCTGAGGCTTTCATGCGCCGCTAGCGGATTCTCCTTCTCCTCTTAC<br>GCCATGTCGTGGGTCCGCCAAGCCCCTGGAAAAGGCCTGGAATGGGTGTCCGC<br>GATTTCCGGGAGCGGAGGTTCGACCTATTACGCCGACTCCGTGAAGGGCCGCT<br>TTACCATCTCCCGGGATAACTCCAAGAACACTCTGTACCTCCAAATGAACTCG<br>CTGAGAGCCGAGGACACCGCCGTGTATTACTGCGCGAAGGCGCTGGTCGGCGC<br>GACTGGGGCATTCGACATCTGGGGACAGGGAACTCTTGTGACCGTGTCGAGCG<br>GAGGCGGCGGCTCCGGCGGAGGAGGGAGCGGGGGCGGTGGTTCCGAAATCGTG<br>TTGACTCAGTCCCCGGGAACCCTGAGCTTGTCACCCGGGGAGCGGGCCACTCT<br>CTCCTGTCGCGCCTCCCAATCGCTCTCATCCAATTTCCTGGCCTGGTACCAGC<br>AGAAGCCCGACAGGCCCCGGGCCTGCTCATCTACGGCGCTTCAAACTGGGCA<br>ACGGGAACCCCTGATCGGTTCAGCGGAAGCGGATCGGGTACTGACTTTACCCT<br>GACCATCACCAGACTGGAACCGGAGGACTTCGCCGTGTACTACTGCCAGTACT<br>ACGGCACCTCCCCCATGTACACATTCGGACAGGGTACCAAGGTCGAGATTAAG<br>ACCACTACCCCAGCACCGAGGCCACCCACCCCGGCTCCTACCATCGCCTCCCA<br>GCCTCTGTCCCTGCGTCCGGAGGCATGTAGACCCGCAGCTGGTGGGGCCGTGC<br>ATACCCGGGGTCTTGACTTCGCCTGCGATATCTACATTTGGGCCCCTCTGGCT<br>GGTACTTGCGGGGTCCTGCTGCTTTCACTCGTGATCACTCTTTACTGTAAGCG<br>CGGTCGGAAGAAGCTGCTGTACATCTTTAAGCAACCCTTCATGAGGCCTGTGC<br>AGACTACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCAGCCTA<br>CAAGCAGGGGCAGAACCAGCTCTACAACGAACTCAATCTTGGTCGGAGAGAGG<br>AGTACGACGTGCTGGACAAGCGGAGAGGACGGGACCCAGAAATGGGCGGGAAG<br>CCGCGCAGAAAGAATCCCCAAGAGGGCCTGTACAACGAGCTCCAAAAGGATAA<br>GATGGCAGAAGCCTATAGCGAGATTGGTATGAAAGGGGAACGCAGAAGAGGCA<br>AAGGCCACGACGGACTGTACCAGGGACTCAGCACCGCCACCAAGGACACCTAT<br>GACGCTCTTCACATGCAGGCCCTGCCGCCTCGG |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/ Description | SEQ ID NO: | Sequence |
|---|---|---|
| | | BCMA_EBB-C1980-A2 |
| BCMA_EBB-C1980-A2- aa ScFv domain | 147 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCVLWFGEGFDP WGQGTLVTVSSGGGGSGGGGSGGGGSDIVLTQSPLSLPVTPGEPASISCRSSQ SLLHSNGYNYLDWYLQKPGQSPQLLIYLGSNRASGVPDRFSGSGSGTDFTLKI SRVEAEDVGVYYCMQALQTPLTFGGGTKVDIK |
| BCMA_EBB-C1980-A2- nt ScFv domain | 168 | GAAGTGCAGCTGCTTGAGAGCGGTGGAGGTCTGGTGCAGCCCGGGGGATCACT GCGCCTGTCCTGTGCCGCGTCCGGTTTCACTTTCTCCTCGTACGCCATGTCGT GGGTCAGACAGGCACCGGGAAAGGGACTGGAATGGGTGTCAGCCATTTCGGGT TCGGGGGGCAGCACCTACTACGCTGACTCCGTGAAGGGCCGGTTCACCATTTC CCGCGACAACTCCAAGAACACCTTGTACCTCCAAATGAACTCCCTGCGGGCCG AAGATACCGCCGTGTATTACTGCGTGCTGTGGTTCGGAGAGGGATTCGACCCG TGGGGACAAGGAACACTCGTGACTGTGTCATCCGGCGGAGGCGGCAGCGGTGG CGGCGGTTCCGGCGGCGGCGGATCTGACATCGTGTTGACCCAGTCCCCTCTGA GCCTGCCGGTCACTCCTGGCGAACCAGCCAGCATCTCCTGCCGGTCGAGCCAG TCCCTCCTGCACTCCAATGGGTACAACTACCTCGATTGGTATCTGCAAAAGCC GGGCCAGAGCCCCCAGCTGCTGATCTACCTTGGGTCAAACCGCGCTTCCGGGG TGCCTGATAGATTCTCCGGGTCCGGGAGCGGAACCGACTTTACCCTGAAAATC TCGAGGGTGGAGGCCGAGGACGTCGGAGTGTACTACTGCATGCAGGCGCTCCA GACTCCCCTGACCTTCGGAGGAGGAACGAAGGTCGACATCAAGA |
| BCMA_EBB-C1980-A2- aa VH | 189 | EVQLLESGGGLVQPGGSLRLSCAASGFTFSSYAMSWVRQAPGKGLEWVSAISG SGGSTYYADSVKGRFTISRDNSKNTLYLQMNSLRAEDTAVYYCVLWFGEGFDP WGQGTLVTVSS |
| BCMA_EBB-C1980-A2- aa VL | 210 | DIVLTQSPLSLPVTPGEPASISCRSSQSLLHSNGYNYLDWYLQKPGQSPQLLI YLGSNRASGVPDRFSGSGSGTDFTLKISRVEAEDVGVYYCMQALQTPLTFGGG TKVDIK |
| BCMA_EBB-C1980-A2- aa Full CART | 231 | MALPVTALLLPLALLLHAARPEVQLLESGGGLVQPGGSLRLSCAASGFTFSSY AMSWVRQAPGKGLEWVSAISGSGGSTYYADSVKGRFTISRDNSKNTLYLQMNS LRAEDTAVYYCVLWFGEGFDPWGQGTLVTVSSGGGGSGGGGSGGGGSDIVLTQ SPLSLPVTPGEPASISCRSSQSLLHSNGYNYLDWYLQKPGQSPQLLIYLGSNR ASGVPDRFSGSGSGTDFTLKISRVEAEDVGVYYCMQALQTPLTFGGGTKVDIK TTTPAPRPPTPAPTIASQPLSLRPEACRPAAGGAVHTRGLDFACDIYIWAPLA GTCGVLLLSLVITLYCKRGRKKLLYIFKQPFMRPVQTTQEEDGCSCRFPEEEE GGCELRVKFSRSADAPAYKQGQNQLYNELNLGRREEYDVLDKRRGRDPEMGGK PRRKNPQEGLYNELQKDKMAEAYSEIGMKGERRRGKGHDGLYQGLSTATKDTY DALHMQALPPR |
| BCMA_EBB-C1980-A2- nt Full CART | 252 | ATGGCCCTCCCTGTCACCGCCCTGCTGCTTCCGCTGGCTCTTCTGCTCCACGC CGCTCGGCCCGAAGTGCAGCTGCTTGAGAGCGGTGGAGGTCTGGTGCAGCCCG GGGGATCACTGCGCCTGTCCTGTGCCGCGTCCGGTTTCACTTTCTCCTCGTAC GCCATGTCGTGGGTCAGACAGGCACCGGGAAAGGGACTGGAATGGGTGTCAGC CATTTCGGGTTCGGGGGGCAGCACCTACTACGCTGACTCCGTGAAGGGCCGGT TCACCATTTCCCGCGACAACTCCAAGAACACCTTGTACCTCCAAATGAACTCC CTGCGGGCCGAAGATACCGCCGTGTATTACTGCGTGCTGTGGTTCGGAGAGGG ATTCGACCCGTGGGGACAAGGAACACTCGTGACTGTGTCATCCGGCGGAGGCG GCAGCGGTGGCGGCGGTTCCGGCGGCGGCGGATCTGACATCGTGTTGACCCAG TCCCCTCTGAGCCTGCCGGTCACTCCTGGCGAACCAGCCAGCATCTCCTGCCG GTCGAGCCAGTCCCTCCTGCACTCCAATGGGTACAACTACCTCGATTGGTATC TGCAAAAGCCGGGCCAGAGCCCCCAGCTGCTGATCTACCTTGGGTCAAACCGC GCTTCCGGGGTGCCTGATAGATTCTCCGGGTCCGGGAGCGGAACCGACTTTAC CCTGAAAATCTCGAGGGTGGAGGCCGAGGACGTCGGAGTGTACTACTGCATGC AGGCGCTCCAGACTCCCCTGACCTTCGGAGGAGGAACGAAGGTCGACATCAAG ACCACTACCCCAGCACCGAGGCCACCCACCCCGGCTCCTACCATCGCCTCCCA GCCTCTGTCCCTGCGTCCGGAGGCATGTAGACCCGCAGCTGGTGGGGCCGTGC ATACCCGGGGTCTTGACTTCGCCTGCGATATCTACATTTGGGCCCCTCTGGCT GGTACTTGCGGGGTCCTGCTGCTTTCACTCGTGATCACTCTTTACTGTAAGCG CGGTCGGAAGAAGCTGCTGTACATCTTTAAGCAACCCTTCATGAGGCCTGTGC AGACTACTCAAGAGGAGGACGGCTGTTCATGCCGGTTCCCAGAGGAGGAGGAA GGCGGCTGCGAACTGCGCGTGAAATTCAGCCGCAGCGCAGATGCTCCAGCCTA CAAGCAGGGCAGAACCAGCTCTACAACGAACTCAATCTTGGTCGGAGAGAGG AGTACGACGTGCTGGACAAGCGGAGAGGACGGGACCCAGAAATGGGCGGGAAG CCGCGCAGAAAGAATCCCCAAGAGGGCCTGTACAACGAGCTCCAAAAGGATAA GATGGCAGAAGCCTATAGCGAGATTGGTATGAAAGGGGAACGCAGAAGAGGCA AAGGCCACGACGGACTGTACCAGGGACTCAGCACCGCCACCAAGGACACCTAT GACGCTCTTCACATGCAGGCCCTGCCGCCTCGG |
| | | BCMA_EBB-C1981-C3 |
| BCMA_EBB-C1981-C3- aa ScFv domain | 148 | QVQLVESGGGLVQPGGSLRLSCAASGFTFSSYAMSWVRQAPGKGLEWVSAISG SGGSTYYADSVKGRFTISRDNSKNTLYLQMNSLRAEDTAVYYCAKVGYDSSGY YRDYYGMDVWGQGTTVTVSSGGGGSGGGGSGGGGSEIVLTQSPGTLSLSPGER |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | ATLSCRASQSVSSSYLAWYQQKPGQAPRLLIYGTSSRATGISDRFSGSGSGTD<br>FTLTISRLEPEDFAVYYCQHYGNSPPKFTFGPGTKLEIK |
| BCMA_EBB-<br>C1981-C3- nt<br>ScFv domain | 169 | CAAGTGCAGCTCGTGGAGTCAGGCGGAGGACTGGTGCAGCCCGGGGGCTCCCT<br>GAGACTTTCCTGCGCGGCATCGGGTTTTACCTTCTCCTCCTATGCTATGTCCT<br>GGGTGCGCCAGGCCCCGGGAAAGGGACTGGAATGGGTGTCCGCAATCAGCGGT<br>AGCGGGGGCTCAACATACTACGCCGACTCCGTCAAGGGTCGCTTCACTATTTC<br>CCGGGACAACTCCAAGAATACCCTGTACCTCCAAATGAACAGCCTCAGGGCCG<br>AGGATACTGCCGTGTACTACTGCGCCAAAGTCGGATACGATAGCTCCGGTTAC<br>TACCGGGACTACTACGGAATGGACGTGTGGGGACAGGGCACCACCGTGACCGT<br>GTCAAGCGGCGGAGGCGGTTCAGGAGGGGGAGGCTCCGGCGGTGGAGGGTCCG<br>AAATCGTCCTGACTCAGTCGCCTGGCACTCTGTCGTTGTCCCCGGGGAGCGC<br>GCTACCCTGTCGTGTCGGGCGTCGCAGTCCGTGTCGAGCTCCTACCTCGCGTG<br>GTACCAGCAGAAGCCCGGACAGGCCCCTAGACTTCTGATCTACGGCACTTCTT<br>CACGCGCCACCGGGATCAGCGACAGGTTCAGCGGCTCCGGCTCCGGGACCGAC<br>TTCACCCTGACCATTAGCCGGCTGGAGCCTGAAGATTTCGCCGTGTATTACTG<br>CCAACACTACGGAAACTCGCCGCCAAAGTTCACGTTCGGACCCGGAACCAAGC<br>TGGAAATCAAG |
| BCMA_EBB-<br>C1981-C3- aa<br>VH | 190 | QVQLVESGGGLVQPGGSLRLSCAASGFTFSSYAMSWVRQAPGKGLEWVSAISG<br>SGGSTYYADSVKGRFTISRDNSKNTLYLQMNSLRAEDTAVYYCAKVGYDSSGY<br>YRDYYGMDVWGQGTTVTVSS |
| BCMA_EBB-<br>C1981-C3- aa<br>VL | 211 | EIVLTQSPGTLSLSPGERATLSCRASQSVSSSYLAWYQQKPGQAPRLLIYGTS<br>SRATGISDRFSGSGSGTDFTLTISRLEPEDFAVYYCQHYGNSPPKFTFGPGTK<br>LEIK |
| BCMA_EBB-<br>C1981-C3- aa<br>Full CART | 232 | MALPVTALLLPLALLLHAARPQVQLVESGGGLVQPGGSLRLSCAASGFTFSSY<br>AMSWVRQAPGKGLEWVSAISGSGGSTYYADSVKGRFTISRDNSKNTLYLQMNS<br>LRAEDTAVYYCAKVGYDSSGYYRDYYGMDVWGQGTTVTVSSGGGGSGGGGSGG<br>GGSEIVLTQSPGTLSLSPGERATLSCRASQSVSSSYLAWYQQKPGQAPRLLIY<br>GTSSRATGISDRFSGSGSGTDFTLTISRLEPEDFAVYYCQHYGNSPPKFTFGP<br>GTKLEIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGCSC<br>RFPEEEEGGCELRVKFSRSADAPAYKQGQNQLYNELNLGRREEYDVLDKRRGR<br>DPEMGGKPRRKNPQEGLYNELQKDKMAEAYSEIGMKGERRRGKGHDGLYQGLS<br>TATKDTYDALHMQALPPR |
| BCMA_EBB-<br>C1981-C3- nt<br>Full CART | 253 | ATGGCCCTCCCTGTCACCGCCCTGCTGCTTCCGCTGGCTCTTCTGCTCCACGC<br>CGCTCGGCCCCAAGTGCAGCTCGTGGAGTCAGGCGGAGGACTGGTGCAGCCCG<br>GGGGCTCCCTGAGACTTTCCTGCGCGGCATCGGGTTTTACCTTCTCCTCCTAT<br>GCTATGTCCTGGGTGCGCCAGGCCCCGGGAAAGGGACTGGAATGGGTGTCCGC<br>AATCAGCGGTAGCGGGGGCTCAACATACTACGCCGACTCCGTCAAGGGTCGCT<br>TCACTATTTCCCGGGACAACTCCAAGAATACCCTGTACCTCCAAATGAACAGC<br>CTCAGGGCCGAGGATACTGCCGTGTACTACTGCGCCAAAGTCGGATACGATAG<br>CTCCGGTTACTACCGGGACTACTACGGAATGGACGTGTGGGGACAGGGCACCA<br>CCGTGACCGTGTCAAGCGGCGGAGGCGGTTCAGGAGGGGGAGGCTCCGGCGGT<br>GGAGGGTCCGAAATCGTCCTGACTCAGTCGCCTGGCACTCTGTCGTTGTCCCC<br>GGGGGAGCGCGCTACCCTGTCGTGTCGGGCGTCGCAGTCCGTGTCGAGCTCCT<br>ACCTCGCGTGGTACCAGCAGAAGCCCGGACAGGCCCCTAGACTTCTGATCTAC<br>GGCACTTCTTCACGCGCCACCGGGATCAGCGACAGGTTCAGCGGCTCCGGCTC<br>CGGGACCGACTTCACCCTGACCATTAGCCGGCTGGAGCCTGAAGATTTCGCCG<br>TGTATTACTGCCAACACTACGGAAACTCGCCGCCAAAGTTCACGTTCGGACCC<br>GGAACCAAGCTGGAAATCAAGACCACTACCCCAGCACCGAGGCCACCCACCCC<br>GGCTCCTACCATCGCCTCCCAGCCTCTGTCCCTGCGTCCGGAGGCATGTAGAC<br>CCGCAGCTGGTGGGGCCGTGCATACCCGGGTCTTGACTTCGCCTGCGATATC<br>TACATTTGGGCCCCTCTGGCTGGTACTTGCGGGGTCCTGCTGCTTTCACTCGT<br>GATCACTCTTTACTGTAAGCGCGGTCGGAAGAAGCTGCTGTACATCTTTAAGC<br>AACCCTTCATGAGGCCTGTGCAGACTACTCAAGAGGAGGACGGCTGTTCATGC<br>CGGTTCCCAGAGGAGGAGGAAGGCGGCTGCGAACTGCGCGTGAAATTCAGCCG<br>CAGCGCAGATGCTCCAGCCTACAAGCAGGGGCAGAACCAGCTCTACAACGAAC<br>TCAATCTTGGTCGGAGAGAGGAGTACGACGTGCTGGACAAGCGGAGAGGACGG<br>GACCCAGAAATGGGCGGGAAGCCGCGCAGAAAGAATCCCCAAGAGGGCCTGTA<br>CAACGAGCTCCAAAAGGATAAGATGGCAGAAGCCTATAGCGAGATTGGTATGA<br>AAGGGGAACGCAGAAGAGGCAAAGGCCACGACGGACTGTACCAGGGACTCAGC<br>ACCGCCACCAAGGACACCTATGACGCTCTTCACATGCAGGCCCTGCCGCCTCG<br>G |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| BCMA_EBB-C1978-G4 | | |
| BCMA_EBB-<br>C1978-G4- aa<br>ScFv domain | 149 | EVQLVESGGGLVQPGGSLRLSCAASGFTFSSYAMSWVRQAPGKGLEWVSAISG<br>SGGSTYYADSVKGRFTISRDNSKNTLYLQMNSLRAEDTAVYYCAKMGWSSGYL<br>GAFDIWGQGTTVTVSSGGGGSGGGGSGGGGSEIVLTQSPGTLSLSPGERATLS<br>CRASQSVASSFLAWYQQKPGQAPRLLIYGASGRATGIPDRFSGSGSGTDFTLT<br>ISRLEPEDFAVYYCQHYGGSPRLTFGGGTKVDIK |
| BCMA_EBB-<br>C1978-G4- nt<br>ScFv domain | 170 | GAAGTCCAACTGGTGGAGTCCGGGGGAGGGCTCGTGCAGCCCGGAGGCAGCCT<br>TCGGCTGTCGTGCGCCGCCTCCGGGTTCACGTTCTCATCCTACGCGATGTCGT<br>GGGTCAGACAGGCACCAGGAAAGGGACTGGAATGGGTGTCCGCCATTAGCGGC<br>TCCGGCGGTAGCACCTACTATGCCGACTCAGTGAAGGGAAGGTTCACTATCTC<br>CCGCGACAACAGCAAGAACACCCTGTACCTCCAAATGAACTCTCTGCGGGCCG<br>AGGATACCGCGGTGTACTATTGCGCCAAGATGGGTTGGTCCAGCGGATACTTG<br>GGAGCCTTCGACATTTGGGACAGGGCACTACTGTGACCGTGTCCTCCGGGGG<br>TGGCGGATCGGGAGGCGGCGGCTCGGGTGGAGGGGGTTCCGAAATCGTGTTGA<br>CCCAGTCACCGGGAACCCTCTCGCTGTCCCCGGGAGAACGGGCTACACTGTCA<br>TGTAGAGCGTCCCAGTCCGTGGCTTCCTCGTTCCTGGCCTGGTACCAGCAGAA<br>GCCGGGACAGGCACCCCGCCTGCTCATCTACGGAGCCAGCGGCCGGGCGACCG<br>GCATCCCTGACCGCTTCTCCGGTTCCGGCTCGGGCACCGACTTTACTCTGACC<br>ATTAGCAGGCTTGAGCCCGAGGATTTTGCCGTGTACTACTGCCAACACTACGG<br>GGGGAGCCCTCGCCTGACCTTCGGAGGCGGAACTAAGGTCGATATCAAA |
| BCMA_EBB-<br>C1978-G4- aa<br>VH | 191 | EVQLVESGGGLVQPGGSLRLSCAASGFTFSSYAMSWVRQAPGKGLEWVSAISG<br>SGGSTYYADSVKGRFTISRDNSKNTLYLQMNSLRAEDTAVYYCAKMGWSSGYL<br>GAFDIWGQGTTVTVSS |
| BCMA_EBB-<br>C1978-G4- aa<br>VL | 212 | EIVLTQSPGTLSLSPGERATLSCRASQSVASSFLAWYQQKPGQAPRLLIYGAS<br>GRATGIPDRFSGSGSGTDFTLTISRLEPEDFAVYYCQHYGGSPRLTFGGGTKV<br>DIK |
| BCMA_EBB-<br>C1978-G4- aa<br>Full CART | 233 | MALPVTALLLPLALLLHAARPEVQLVESGGGLVQPGGSLRLSCAASGFTFSSY<br>AMSWVRQAPGKGLEWVSAISGSGGSTYYADSVKGRFTISRDNSKNTLYLQMNS<br>LRAEDTAVYYCAKMGWSSGYLGAFDIWGQGTTVTVSSGGGGSGGGGSGGGGSE<br>IVLTQSPGTLSLSPGERATLSCRASQSVASSFLAWYQQKPGQAPRLLIYGASG<br>RATGIPDRFSGSGSGTDFTLTISRLEPEDFAVYYCQHYGGSPRLTFGGGTKVD<br>IKTTTPAPRPPTPAPTIASQPLSLRPEACRPAAGGAVHTRGLDFACDIYIWAP<br>LAGTCGVLLLSLVITLYCKRGRKKLLYIFKQPFMRPVQTTQEEDGCSCRFPEE<br>EEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKD<br>TYDALHMQALPPR |
| BCMA_EBB-<br>C1978-G4- nt<br>Full CART | 254 | ATGGCCCTCCCTGTCACCGCCCTGCTGCTTCCGCTGGCTCTTCTGCTCCACGC<br>CGCTCGGCCCGAAGTCCAACTGGTGGAGTCCGGGGGAGGGCTCGTGCAGCCCG<br>GAGGCAGCCTTCGGCTGTCGTGCGCCGCCTCCGGGTTCACGTTCTCATCCTAC<br>GCGATGTCGTGGGTCAGACAGGCACCAGGAAAGGGACTGGAATGGGTGTCCGC<br>CATTAGCGGCTCCGGCGGTAGCACCTACTATGCCGACTCAGTGAAGGGAAGGT<br>TCACTATCTCCCGCGACAACAGCAAGAACACCCTGTACCTCCAAATGAACTCT<br>CTGCGGGCCGAGGATACCGCGGTGTACTATTGCGCCAAGATGGGTTGGTCCAG<br>CGGATACTTGGGAGCCTTCGACATTTGGGACAGGGCACTACTGTGACCGTGT<br>CCTCCGGGGGTGGCGGATCGGGAGGCGGCGGCTCGGGTGGAGGGGGTTCCGAA<br>ATCGTGTTGACCCAGTCACCGGGAACCCTCTCGCTGTCCCCGGGAGAACGGGC<br>TACACTGTCATGTAGAGCGTCCCAGTCCGTGGCTTCCTCGTTCCTGGCCTGGT<br>ACCAGCAGAAGCCGGGACAGGCACCCCGCCTGCTCATCTACGGAGCCAGCGGC<br>CGGGCGACCGGCATCCCTGACCGCTTCTCCGGTTCCGGCTCGGGCACCGACTT<br>TACTCTGACCATTAGCAGGCTTGAGCCCGAGGATTTTGCCGTGTACTACTGCC<br>AACACTACGGGGGGAGCCCTCGCCTGACCTTCGGAGGCGGAACTAAGGTCGAT<br>ATCAAAACCACTACCCCAGCACCGAGGCCACCCACCCCGGCTCCTACCATCGC<br>CTCCCAGCCTCTGTCCCTGCGTCCGGAGGCATGTAGACCCGCAGCTGGTGGGG<br>CCGTGCATACCCGGGGTCTTGACTTCGCCTGCGATATCTACATTTGGGCCCCT<br>CTGGCTGGTACTTGCGGGTCCTGCTGCTTTCACTCGTGATCACTCTTTACTG<br>TAAGCGCGGTCGGAAGAAGCTGCTGTACATCTTTAAGCAACCCTTCATGAGGC<br>CTGTGCAGACTACTCAAGAGGAGGACGGCTGTTCATGCCGGTTCCCAGAGGAG<br>GAGGAAGGCGGCTGCGAACTGCGCGTGAAATTCAGCCGCAGCGCAGATGCTCC<br>AGCCTACAAGCAGGGGCAGAACCAGCTCTACAACGAACTCAATCTTGGTCGGA<br>GAGAGGAGTACGACGTGCTGGACAAGCGGAGAGGACGGGACCCAGAAATGGGC |

TABLE 8-continued

Amino Acid and Nucleic Acid Sequences of exemplary anti-BCMA scFv
domains and BCMA CAR molecules
The amino acid sequences variable heavy chain and variable light chain sequences
for each scFv is also provided. Table 2 lists names and CAR construct
IDs for several BCMA CARs.

| Name/<br>Description | SEQ<br>ID<br>NO: | Sequence |
|---|---|---|
| | | GGGAAGCCGCGCAGAAAGAATCCCCAAGAGGGCCTGTACAACGAGCTCCAAAA<br>GGATAAGATGGCAGAAGCCTATAGCGAGATTGGTATGAAAGGGGAACGCAGAA<br>GAGGCAAAGGCCACGACGGACTGTACCAGGGACTCAGCACCGCCACCAAGGAC<br>ACCTATGACGCTCTTCACATGCAGGCCCTGCCGCCTCGG |

Figure 10A:
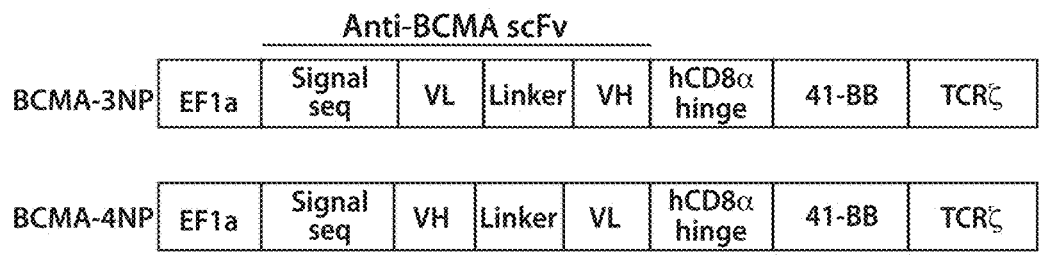
FIGS. 10A and 10B are a series of schematic representations of tool BCMA CAR constructs containing humanized murine anti-BCMA scFvs.
Figure 10B:
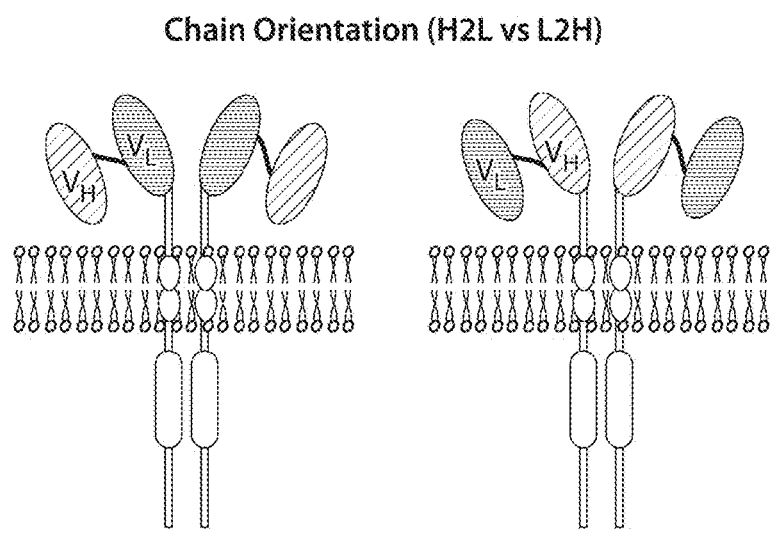

In embodiments, additional exemplary BCMA CAR constructs are generated using the VH and VL sequences from PCT Publication WO2012/0163805 (the contents of which are hereby incorporated by reference in its entirety), e.g., based upon the results from the pBCMA3 and pBCMA4 CARs described in Examples 2 and 3. A schematic of the exemplary BCMA constructs (BCMA-3NP and BCMA-4NP) is shown in FIG. 10A. The two constructs differ in the orientation of the VH and VL chains (FIG. 10B). Exemplary BCMA CAR constructs and their corresponding DNA ID are shown below in Table 9.

TABLE 9

| Tool CAR construct IDs | | |
|---|---|---|
| Nickname | Novartis ID | DNA2.0 ID |
| BCMA-3NP | | 126022 |
| BCMA-4NP | | 126021 |

In embodiments, additional exemplary BCMA CAR constructs can also be generated using the VH and VL sequences found in Table 10. The amino acid sequences of exemplary scFv domains comprising the VH and VL domains and a linker sequence, and full-length CARs are also found in Table 10.

TABLE 10

Additional exemplary BCMA CAR sequences

| Name | Sequence | SEQ<br>ID<br>NO: |
|---|---|---|
| A7D12.2<br>VH | QIQLVQSGPDLKKPGETVKLSCKASGYTFTNFGMNWVKQAPGKGFKWMAWINTYTGESYFA<br>DDFKGRFAFSVETSATTAYLQINNLKTEDTATYFCARGEIYYGYDGGFAYWGQGTLVTVSA | 255 |
| A7D12.2<br>VL | DVVMTQSHRFMSTSVGDRVSITCRASQDVNTAVSWYQQKPGQSPKLLIFSASYRYTGVPDR<br>FTGSGSGADFTLTISSVQAEDLAVYYCQQHYSTPWTFGGGTKLDIK | 259 |
| A7D12.2<br>scFv<br>domain | QIQLVQSGPDLKKPGETVKLSCKASGYTFTNFGMNWVKQAPGKGFKWMAWINTYTGESYFA<br>DDFKGRFAFSVETSATTAYLQINNLKTEDTATYFCARGEIYYGYDGGFAYWGQGTLVTVSA<br>GGGGSGGGGSGGGGSDVVMTQSHRFMSTSVGDRVSITCRASQDVNTAVSWYQQKPGQSPKL<br>LIFSASYRYTGVPDRFTGSGSGADFTLTISSVQAEDLAVYYCQQHYSTPWTFGGGTKLDIK | 263 |
| A7D12.2<br>Full<br>CART | QIQLVQSGPDLKKPGETVKLSCKASGYTFTNFGMNWVKQAPGKGFKWMAWINTYTGESYFA<br>DDFKGRFAFSVETSATTAYLQINNLKTEDTATYFCARGEIYYGYDGGFAYWGQGTLVTVSA<br>GGGGSGGGGSGGGGSDVVMTQSHRFMSTSVGDRVSITCRASQDVNTAVSWYQQKPGQSPKL<br>LIFSASYRYTGVPDRFTGSGSGADFTLTISSVQAEDLAVYYCQQHYSTPWTFGGGTKLDIK<br>TTTPAPRPPTPAPTIASQPLSLRPEACRPAAGGAVHTRGLDFACDIYIWAPLAGTCGVLLL<br>SLVITLYCKRGRKKLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLYNELQKDKMAEAYS<br>EIGMKGERRRGKGHDGLYQGLSTATKDTYDALHMQALPPR | 267 |
| C11D5.3<br>VH | QIQLVQSGPELKKPGETVKISCKASGYTFTDYSINWVKRAPGKGLKWMGWINTETREPAYA<br>YDFRGRFAFSLETSASTAYLQINNLKYEDTATYFCALDYSYAMDYWGQGTSVTVSS | 256 |

TABLE 10-continued

Additional exemplary BCMA CAR sequences

| Name | Sequence | SEQ ID NO: |
|---|---|---|
| C11D5.3 VL | DIVLTQSPASLAMSLGKRATISCRASESVSVIGAHLIHWYQQKPGQPPKLLIYLASNLETG VPARFSGSGSGTDFTLTIDPVEEDDVAIYSCLQSRIFPRTFGGGTKLEIK | 260 |
| C11D53 scFv domain | QIQLVQSGPELKKPGETVKISCKASGYTFTDYSINWVKRAPGKGLKWMGWINTETREPAYA YDFRGRFAFSLETSASTAYLQINNLKYEDTATYFCALDYSYAMDYWGQGTSVTVSSGGGGS GGGGSGGGGSQIQLVQSGPELKKPGETVKISCKASGYTFTDYSINWVKRAPGKGLKWMGWI NTETREPAYAYDFRGRFAFSLETSASTAYLQINNLKYEDTATYFCALDYSYAMDYWGQGTS VTVSS | 264 |
| C11D53 Full CART | QIQLVQSGPELKKPGETVKISCKASGYTFTDYSINWVKRAPGKGLKWMGWINTETREPAYA YDFRGRFAFSLETSASTAYLQINNLKYEDTATYFCALDYSYAMDYWGQGTSVTVSSGGGGS GGGGSGGGGSQIQLVQSGPELKKPGETVKISCKASGYTFTDYSINWVKRAPGKGLKWMGWI NTETREPAYAYDFRGRFAFSLETSASTAYLQINNLKYEDTATYFCALDYSYAMDYWGQGTS VTVSSTTTPAPRPPTPAPTIASQPLSLRPEACRPAAGGAVHTRGLDFACDIYIWAPLAGTC GVLLLSLVITLYCKRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR | 268 |
| C12A3.2 VH | QIQLVQSGPELKKPGETVKISCKASGYTFRHYSMNWVKQAPGKGLKWMGRINTESGVPIYA DDFKGRFAFSVETSASTAYLVINNLKDEDTASYFCSNDYLYSLDFWGQGTALTVSS | 257 |
| C12A3.2 VL | DIVLTQSPPSLAMSLGKRATISCRASESVTILGSHLIYWYQQKPGQPPTLLIQLASNVQTG VPARFSGSGSRTDFTLTIDPVEEDDVAVYYCLQSRTIPRTFGGGTKLEIK | 261 |
| C12A3.2 scFv domain | QIQLVQSGPELKKPGETVKISCKASGYTFRHYSMNWVKQAPGKGLKWMGRINTESGVPIYA DDFKGRFAFSVETSASTAYLVINNLKDEDTASYFCSNDYLYSLDFWGQGTALTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIK | 265 |
| C12A3.2 Full CART | QIQLVQSGPELKKPGETVKISCKASGYTFRHYSMNWVKQAPGKGLKWMGRINTESGVPIYA DDFKGRFAFSVETSASTAYLVINNLKDEDTASYFCSNDYLYSLDFWGQGTALTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIKT TTPAPRPPTPAPTIASQPLSLRPEACRPAAGGAVHTRGLDFACDIYIWAPLAGTCGVLLLS LVITLYCKRGRKKLLYIFKQPFMRPVQTTQEEDGCSCRFPEEEEGGCELRVKFSRSADAPA YKQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR | 269 |
| C13F12.1 VH | QIQLVQSGPELKKPGETVKISCKASGYTFTHYSMNWVKQAPGKGLKWMGRINTETGEPLYA DDFKGRFAFSLETSASTAYLVINNLKNEDTATFFCSNDYLYSCDYWGQGTTLTVSS | 258 |
| C13F12.1 VL | DIVLTQSPPSLAMSLGKRATISCRASESVTILGSHLIYWYQQKPGQPPTLLIQLASNVQTG VPARFSGSGSRTDFTLTIDPVEEDDVAVYYCLQSRTIPRTFGGGTKLEIK | 262 |
| C13F12.1 scFv domain | QIQLVQSGPELKKPGETVKISCKASGYTFTHYSMNWVKQAPGKGLKWMGRINTETGEPLYA DDFKGRFAFSLETSASTAYLVINNLKNEDTATFFCSNDYLYSCDYWGQGTTLTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIK | 266 |
| C13F12.1 Full CART | QIQLVQSGPELKKPGETVKISCKASGYTFTHYSMNWVKQAPGKGLKWMGRINTETGEPLYA DDFKGRFAFSLETSASTAYLVINNLKNEDTATFFCSNDYLYSCDYWGQGTTLTVSSGGGGS GGGGSGGGGSDIVLTQSPPSLAMSLGKRATISCRASESVTILGSHLIYWYQQKPGQPPTLL IQLASNVQTGVPARFSGSGSRTDFTLTIDPVEEDDVAVYYCLQSRTIPRTFGGGTKLEIKT TTPAPRPPTPAPTIASQPLSLRPEACRPAAGGAVHTRGLDFACDIYIWAPLAGTCGVLLLS LVITLYCKRGRKKLLYIFKQPFMRPVQTTQEEDGCSCRFPEEEEGGCELRVKFSRSADAPA YKQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR | 270 |

In embodiments, the nucleic acid sequence of an exemplary humanized anti-BCMA scFv in which VH precedes the VL (H2L, e.g., pBCMA 2 and pBCMA 4) is as follows:

(SEQ ID NO: 272)
CAGGTGCAGCTGGTCCAGAGCGGCGCCGAAGTGAAGAAGCCCGGCAGCTC

CGTGAAAGTGAGCTGCAAGGCCAGCGGCGGCACCTTCAGCAACTACTGGA

TGCACTGGGTGAGGCAGGCCCCCGGACAGGGCCTGGAGTGGATGGGCGCC

-continued
ACCTACAGGGGCCACAGCGACACCTACTACAACCAGAAGTTCAAGGGCCG

GGTGACCATCACCGCCGACAAGAGCACCAGCACCGCCTACATGGAACTGA

GCAGCCTCAGGAGCGAGGACACCGCTGTGTATTACTGCGCCAGGGGCGCC

ATCTACAACGGCTACGACGTGCTGGACAACTGGGGCCAGGGCACACTAGT

GACCGTGTCCAGCGGTGGAGGAGGTAGCGGAGGAGGCGGGAGCGGTGGAG

GTGGCTCTGGAGGTGGCGGAAGCGACATCCAGATGACCCAGAGCCCTAGC

```
TCACTGAGCGCCAGCGTGGGCGACAGGGTGACCATTACCTGCTCCGCCAG

CCAGGACATCAGCAACTACCTGAACTGGTACCAGCAGAAGCCCGGCAAGG

CCCCCAAGCTGCTGATCTACTACACCTCCAACCTGCACTCCGGCGTGCCC

AGCAGGTTCAGCGGAAGCGGCAGCGGCACCGATTTCACCCTGACCATCTC

CAGCCTGCAGCCCGAGGACTTCGCCACCTACTACTGCCAGCAGTACAGGA

AGCTCCCCTGGACTTTCGGCCAGGGCACCAAACTGGAGATCAAGCGT
```

The corresponding amino acid sequence for the exemplary humanized anti-BCMA scFv in which Vh precedes the VL (H2L, e.g., pBCMA 2 and pBCMA 4) is as follows:

```
                                        (SEQ ID NO: 271)
Q V Q L V Q S G A E V K K P G S S V K V S C K A S
G G T F S N Y W M H W V R Q A P G Q G L E W M G A
T Y R G H S D T Y Y N Q K F K G R V T I T A D K S
T S T A Y M E L S S L R S E D T A V Y Y C A R G A
I Y N G Y D V L D N W G Q G T L V T V S S G G G G
S G G G G S G G G G S G G G G S D I Q M T Q S P S
S L S A S V G D R V T I T C S A S Q D I S N Y L N
W Y Q Q K P G K A P K L L I Y Y T S N L H S G V P
S R F S G S G S G T D F T L T I S S L Q P E D F A
T Y Y C Q Q Y R K L P W T F G Q G T K L E I K R
```

In embodiments, the nucleic acid sequence of an exemplary humanized anti-BCMA scFv in which VL precedes the VH (L2H, e.g., pBCMA1 and pBCMA3) is as follows:

```
                                        (SEQ ID NO: 274)
GACATCCAGATGACCCAGAGCCCTAGCTCACTGAGCGCCAGCGTGGGCGA

CAGGGTGACCATTACCTGCTCCGCCAGCCAGGACATCAGCAACTACCTGA

ACTGGTACCAGCAGAAGCCCGGCAAGGCCCCCAAGCTGCTGATCTACTAC

ACCTCCAACCTGCACTCCGGCGTGCCCAGCAGGTTCAGCGGAAGCGGCAG

CGGCACCGATTTCACCCTGACCATCTCCAGCCTGCAGCCCGAGGACTTCG

CCACCTACTACTGCCAGCAGTACAGGAAGCTCCCCTGGACTTTCGGCCAG

GGCACCAAACTGGAGATCAAGCGTGGTGGAGGAGGTAGCGGAGGAGGCGG

GAGCGGTGGAGGTGGCTCTGGAGGTGGCGGAAGCCAGGTGCAGCTGGTCC

AGAGCGGCGCCGAAGTGAAGAAGCCCGGCAGCTCCGTGAAAGTGAGCTGC

AAGGCCAGCGGCGGCACCTTCAGCAACTACTGGATGCACTGGGTGAGGCA

GGCCCCCGGACAGGGCCTGGAGTGGATGGGCGCCACCTACAGGGCCACA

GCGACACCTACTACAACCAGAAGTTCAAGGGCCGGGTGACCATCACCGCC

GACAAGAGCACCAGCACCGCCTACATGGAACTGAGCAGCCTCAGGAGCGA

GGACACCGCTGTGTATTACTGCGCCAGGGGCGCCATCTACAACGGCTACG

ACGTGCTGGACAACTGGGGCCAGGGCACACTAGTGACCGTGTCCAGC
```

The corresponding amino acid sequence of the exemplary humanized anti-BCMA scFv in which VL precedes the VH (L2H, e.g., pBCMA1 and pBCMA3) is as follows:

```
                                        (SEQ ID NO: 273)
DIQMTQSPSS LSASVGDRVT ITCSASQDIS NYLNWYQQKP
GKAPKLLIYY TSNLHSGVPSRFSGSGSGTD FTLTISSLQP
EDFATYYCQQ YRKLPWTFGQ GTKLEIKRGG GGSGGGGSGGGGSGGGG
SQV QLVQSGAEVK KPGSSVKVSC KASGGTFSNY WMHWVRQAPG
QGLEWMGATYRGHSDTYYNQ KFKGRVTITA DKSTSTAYMELSSLRSED
TA VYYCARGAIYNGYDVLDNWGQGTLVTVSS
```

The CAR scFv fragments can be cloned into lentiviral vectors to create a full length CAR construct in a single coding frame, and using the EF1 alpha promoter for expression (SEQ ID NO: 11).

The CAR construct can include a Gly/Ser linker having one or more of the following sequences: GGGGS (SEQ ID NO:25); encompassing 1-6 "Gly Gly Gly Gly Ser" repeating units, e.g., GGGGSGGGGS GGGGSGGGGS GGGGSGGGGS (SEQ ID NO:26); GGGGSGGGGS GGGGSGGGGS (SEQ ID NO:27); GGGGSGGGGS GGGGS (SEQ ID NO:28); GGGS (SEQ ID NO:29); or encompassing 1-10 "Gly Gly Gly Ser" repeating units, e.g., GGGSGGGSGG GSGGGSGGGS GGGSGGGSGG GSGGGSGGGS (SEQ ID NO:38). In embodiments, the CAR construct include a poly A sequence, e.g., a sequence encompassing 50-5000 or 100-5000 adenines (e.g., SEQ ID NO:30, SEQ ID NO:33, SEQ ID NO:34 or SEQ ID NO:35), or a sequence encompassing 50-5000 thymines (e.g., SEQ ID NO:31, SEQ ID NO:32). Alternatively, the CAR construct can include, for example, a linker including the sequence GSTSGSGKPGSGEGSTKG (SEQ ID NO: 1108)

Bispecific CARs

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope.

In certain embodiments, the antibody molecule is a multi-specific (e.g., a bispecific or a trispecific) antibody molecule.

Protocols for generating bispecific or heterodimeric antibody molecules are known in the art; including but not limited to, for example, the "knob in a hole" approach described in, e.g., U.S. Pat. No. 5,731,168; the electrostatic steering Fc pairing as described in, e.g., WO 09/089004, WO 06/106905 and WO 2010/129304; Strand Exchange Engineered Domains (SEED) heterodimer formation as described in, e.g., WO 07/110205; Fab arm exchange as described in, e.g., WO 08/119353, WO 2011/131746, and WO 2013/060867; double antibody conjugate, e.g., by antibody cross-linking to generate a bi-specific structure using a heterobifunctional reagent having an amine-reactive group and a sulfhydryl reactive group as described in, e.g., U.S. Pat. No. 4,433,059; bispecific antibody determinants generated by recombining half antibodies (heavy-light chain pairs or Fabs) from different antibodies through cycle of reduction and oxidation of disulfide bonds between the two heavy chains, as described in, e.g., U.S. Pat. No. 4,444,878; trifunctional antibodies, e.g., three Fab' fragments crosslinked through sulfhdryl reactive groups, as described in, e.g., U.S. Pat. No. 5,273,743; biosynthetic binding proteins, e.g., pair of scFvs cross-linked through C-terminal tails preferably through disulfide or amine-reactive chemical cross-linking, as described in, e.g., U.S. Pat. No. 5,534,254; bifunctional antibodies, e.g., Fab fragments with different binding specificities dimerized through leucine zippers (e.g., c-fos and c-jun) that have replaced the constant domain, as described in, e.g., U.S. Pat. No. 5,582,996; bispecific and oligospecific mono- and oligovalent receptors, e.g., VH-CH1 regions of two antibodies (two Fab fragments) linked through a polypeptide spacer between the CH1 region of one antibody and the VH region of the other antibody typically with associated light chains, as described in, e.g., U.S. Pat. No. 5,591,828; bispecific DNA-antibody conjugates, e.g., crosslinking of antibodies or Fab fragments through a double stranded piece of DNA, as described in, e.g., U.S. Pat. No. 5,635,602; bispecific fusion proteins, e.g., an expression construct containing two scFvs with a hydrophilic helical peptide linker between them and a full constant region, as described in, e.g., U.S. Pat. No. 5,637,481; multivalent and multispecific binding proteins, e.g., dimer of polypeptides having first domain with binding region of Ig heavy chain variable region, and second domain with binding region of Ig light chain variable region, generally termed diabodies (higher order structures are also encompassed creating for bispecifc, trispecific, or tetraspecific molecules, as described in, e.g., U.S. Pat. No. 5,837,242; minibody constructs with linked VL and VH chains further connected with peptide spacers to an antibody hinge region and CH3 region, which can be dimerized to form bispecific/multivalent molecules, as described in, e.g., U.S. Pat. No. 5,837, 821; VH and VL domains linked with a short peptide linker (e.g., 5 or 10 amino acids) or no linker at all in either orientation, which can form dimers to form bispecific diabodies; trimers and tetramers, as described in, e.g., U.S. Pat. No. 5,844,094; String of VH domains (or VL domains in family members) connected by peptide linkages with cross-linkable groups at the C-terminus futher associated with VL domains to form a series of FVs (or scFvs), as described in, e.g., U.S. Pat. No. 5,864,019; and single chain binding polypeptides with both a VH and a VL domain linked through a peptide linker are combined into multivalent structures through non-covalent or chemical crosslinking to form, e.g., homobivalent, heterobivalent, trivalent, and tetravalent structures using both scFV or diabody type format, as described in, e.g., U.S. Pat. No. 5,869,620. Additional exemplary multispecific and bispecific molecules and methods of making the same are found, for example, in U.S. Pat. No. 5,910,573, U.S. Pat. No. 5,932,448, U.S. Pat. No. 5,959,083, U.S. Pat. No. 5,989,830, U.S. Pat. No. 6,005,079, U.S. Pat. No. 6,239,259, U.S. Pat. No. 6,294,353, U.S. Pat. No. 6,333,396, U.S. Pat. No. 6,476,198, U.S. Pat. No. 6,511,663, U.S. Pat. No. 6,670,453, U.S. Pat. No. 6,743,896, U.S. Pat. No. 6,809,185, U.S. Pat. No. 6,833,441, U.S. Pat. No. 7,129,330, U.S. Pat. No. 7,183,076, U.S. Pat. No. 7,521,056, U.S. Pat. No. 7,527,787, U.S. Pat. No. 7,534,866, U.S. Pat. No. 7,612,181, US2002004587A1, US2002076406A1, US2002103345A1, US2003207346A1, US2003211078A1, US2004219643A1, US2004220388A1, US2004242847A1, US2005003403A1, US2005004352A1, US2005069552A1, US2005079170A1, US2005100543A1, US2005136049A1, US2005136051A1, US2005163782A1, US2005266425A1, US2006083747A1, US2006120960A1, US2006204493A1, US2006263367A1, US2007004909A1, US2007087381A1, US2007128150A1, US2007141049A1, US2007154901A1, US2007274985A1, US2008050370A1, US2008069820A1, US2008152645A1, US2008171855A1, US2008241884A1, US2008254512A1, US2008260738A1, US2009130106A1, US2009148905A1, US2009155275A1, US2009162359A1, US2009162360A1, US2009175851A1, US2009175867A1, US2009232811A1, US2009234105A1, US2009263392A1, US2009274649A1, EP346087A2, WO0006605A2, WO02072635A2, WO04081051A1, WO06020258A2, WO2007044887A2, WO2007095338A2, WO2007137760A2, WO2008119353A1, WO2009021754A2, WO2009068630A1, WO9103493A1, WO9323537A1, WO9409131A1, WO9412625A2, WO9509917A1, WO9637621A2, WO9964460A1. The contents of the above-referenced applications are incorporated herein by reference in their entireties.

Within each antibody or antibody fragment (e.g., scFv) of a bispecific antibody molecule, the VH can be upstream or downstream of the VL. In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$. In other embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-$VL_2$. Optionally, a linker is disposed between the two antibodies or antibody fragments (e.g., scFvs), e.g., between $VL_1$ and $VL_2$ if the construct is arranged as $VH_1$-$VL_1$-$VL_2$-$VH_2$, or between $VH_1$ and $VH_2$ if the construct is arranged as $VL_1$-$VH_1$-$VH_2$-$VL_2$. The linker may be a linker as described herein, e.g., a ($Gly_4$-Ser)n linker, wherein n is 1, 2, 3, 4, 5, or 6, preferably 4 (SEQ ID NO: 26). In general, the linker between the two scFvs should be long enough to avoid mispairing between the domains of the two scFvs. Optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

In one aspect, the bispecific antibody molecule is characterized by a first immunoglobulin variable domain sequence, e.g., a scFv, which has binding specificity for BCMA, e.g., comprises a scFv as described herein, e.g., as described in Tables 8 or 10, or comprises the light chain CDRs and/or heavy chain CDRs from a BCMA scFv described herein, and a second immunoglobulin variable domain sequence that has binding specificity for a second epitope on a different antigen. In some aspects the second immunoglobulin variable domain sequence has binding specificity for an antigen expressed on AML cells, e.g., an antigen other than BCMA. For example, the second immunoglobulin variable domain sequence has binding specificity for CD123. As another example, the second immunoglobulin variable domain sequence has binding specificity for CLL-1. As another example, the second immunoglobulin variable domain sequence has binding specificity for CD34. As another example, the second immunoglobulin variable domain sequence has binding specificity for FLT3. For example, the second immunoglobulin variable domain sequence has binding specificity for folate receptor beta. In some aspects, the second immunoglobulin variable domain sequence has binding specificity for an antigen expressed on B-cells, for example, CD10, CD19, CD20, CD22, CD34, CD123, FLT-3, ROR1, CD79b, CD179b, or CD79a.

Chimeric TCR

In one aspect, the anti-BCMA antibodies and antibody fragments of the present invention (for example, those disclosed in Tables 8 and 10) can be grafted to one or more constant domain of a T cell receptor ("TCR") chain, for example, a TCR alpha or TCR beta chain, to create an chimeric TCR that binds specificity to BCMA. Without being bound by theory, it is believed that chimeric TCRs will signal through the TCR complex upon antigen binding. For example, a BCMA scFv as disclosed herein, can be grafted to the constant domain, e.g., at least a portion of the extracellular constant domain, the transmembrane domain and the cytoplasmic domain, of a TCR chain, for example, the TCR alpha chain and/or the TCR beta chain. As another example, a BCMA antibody fragment, for example a VL domain as described herein, can be grafted to the constant domain of a TCR alpha chain, and a BCMA antibody fragment, for example a VH domain as described herein, can be grafted to the constant domain of a TCR beta chain (or alternatively, a VL domain may be grafted to the constant domain of the TCR beta chain and a VH domain may be grafted to a TCR alpha chain). As another example, the CDRs of an anti-BCMA antibody or antibody fragment, e.g., the CDRs of an anti-BCMA antibody or antibody fragment as described in Tables 1, 2, 3, 4, 5, or 6 may be grafted into a TCR alpha and/or beta chain to create a chimeric TCR that binds specifically to BCMA. For example, the LCDRs disclosed herein may be grafted into the variable domain of a TCR alpha chain and the HCDRs disclosed herein may be grafted to the variable domain of a TCR beta chain, or vice versa. Such chimeric TCRs may be produced by methods known in the art (For example, Willemsen R A et al, Gene Therapy 2000; 7: 1369-1377; Zhang T et al, Cancer Gene Ther 2004; 11: 487-496; Aggen et al, Gene Ther. 2012 April; 19(4):365-74).

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR is used. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the CAR-expressing cell, e.g., CART cell, surface. In a different aspect the amino acid sequence of the transmembrane domain may be modified or substituted so as to minimize interactions with the binding domains of the native binding partner present in the same CAR-expressing cell, e.g., CART.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD3 epsilon, CD45, CD4, CD5, CD8 (e.g., CD8 alpha, CD8 beta), CD9, CD16, CD22, CD33, CD37, CD64, CD80, CD86, CD134, CD137, CD154. In some embodiments, a transmembrane domain may include at least the transmembrane region(s) of a costimulatory molecule, e.g., MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CD5, ICAM-1, LFA-1 (CD11a/CD18), 4-1BB (CD137), B7-H3, CD5, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO:2. In one aspect, the transmembrane domain comprises (e.g., consists of) a transmembrane domain of SEQ ID NO: 6.

In one aspect, the hinge or spacer comprises an IgG4 hinge. For example, in one embodiment, the hinge or spacer comprises a hinge of the amino acid sequence ESKYGPP-CPPCPAPEFLGGPSVFLFPPKPKDTLMISRTPEVTCV-VVDVSQEDPEVQFNW YVDGVEVHNAKTKPREEQF- NSTYRVVSVLTVLHQDWLNGKEYKCKVSNKGLPSSIEK TISKAKGQPREPQVYTLPPSQEEMTKNQVSLTCLVKGFYPSDIAVEWESNGQPENNYK TTPPVLDSDGSFFLYSRLTVDKSRWQEGNVFSCSVMHEALHNHYTQKSLSLSLGKM (SEQ ID NO:3). In some embodiments, the hinge or spacer comprises a hinge encoded by a nucleotide sequence of GAGAGCAAGTACGGCCCTCCCTGCCCCCTTGCCCTGCCCCCGAGTTCCTGGGCGG ACCCAGCGTGTTCCTGTTCCCCCCCAAGCCCAAGGACACCCTGATGATCAGCCGGA CCCCCGAGGTGACCTGTGTGGTGGTGACGTGTCCCAGGAGGACCCCGAGGTCCA GTTCAACTGGTACGTGGACGGCGTGGAGGTGCACAACGCCAAGACCAAGCCCCGG GAGGAGCAGTTCAATAGCACCTACCGGGTGGTGTCCGTGCTGACCGTGCTGCACCA GGACTGGCTGAACGGCAAGGAATACAAGTGTAAGGTGTCCAACAAGGGCCTGCCC AGCAGCATCGAGAAAACCATCAGCAAGGCCAAGGGCCAGCCTCGGGAGCCCCAGG TGTACACCCTGCCCCCTAGCCAAGAGGAGATGACCAAGAACCAGGTGTCCCTGAC CTGCCTGGTGAAGGGCTTCTACCCCAGCGACATCGCCGTGGAGTGGGAGAGCAAC GGCCAGCCCGAGAACAACTACAAGACCACCCCCCCTGTGCTGGACAGCGACGGCA GCTTCTTCCTGTACAGCCGGCTGACCGTGGACAAGAGCCGGTGGCAGGAGGGCAA CGTCTTTAGCTGCTCCGTGATGCACGAGGCCCTGCACAACCACTACACCCAGAAGA GCCTGAGCCTGTCCCTGGGCAAGATG (SEQ ID NO:14).

In one aspect, the hinge or spacer comprises an IgD hinge. For example, in one embodiment, the hinge or spacer comprises a hinge of the amino acid sequence RWPESPKAQASSVPTAQPQAEGSLAKATTAPATTRNTGRGGEEKKKEKEKEEQEERET KTPECPSHTQPLGVYLLTPAVQDLWLRDKATFTCFVVGSDLKDAHLTWEVAGKVPTG GVEEGLLERHSNGSQSQHSRLTLPRSLWNAGTSVTCTLNHPSLPPQRLMALREPAAQA PVKLSLNLLASSDPPEAASWLLCEVSGFSPPNILLMWLEDQREVNTSGFAPARPPPQPG STTFWAWSVLRVPAPPSPQPATYTCVVSHEDSRTLLNASRSLEVSYVTDH (SEQ ID NO:4). In some embodiments, the hinge or spacer comprises a hinge encoded by a nucleotide sequence of AGGTGGCCCGAAAGTCCCAAGGCCCAGGCATCTAGTGTTCCTACTGCACAGCCCCA GGCAGAAGGCAGCCTAGCCAAAGCTACTACTGCACCTGCCACTACGCGCAATACT GGCCGTGGCGGGAGGAGAAGAAAAAGGAGAAAGAGAAAGAAGAACAGGAAGA GAGGGAGACCAAGACCCCTGAATGTCCATCCCATACCCAGCCGCTGGGCGTCTATC TCTTGACTCCCGCAGTACAGGACTTGTGGCTTAGAGATAAGGCCACCTTTACATGT TTCGTCGTGGGCTCTGACCTGAAGGATGCCCATTTGACTTGGGAGGTTGCCGGAAA GGTACCCACAGGGGGGGTTGAGGAAGGGTTGCTGGAGCGCCATTCCAATGGCTCT CAGAGCCAGCACTCAAGACTCACCCTTCCGAGATCCCTGTGGAACGCCGGGACCTC TGTCACATGTACTCTAAATCATCCTAGCCTGCCCCCACAGCGTCTGATGGCCCTTAG AGAGCCAGCCGCCCAGGCACCAGTTAAGCTTAGCCTGAATCTGCTCGCCAGTAGTG ATCCCCCAGAGGCCGCCAGCTGGCTCTTATGCGAAGTGTCCGGCTTTAGCCCGCCC AACATCTTGCTCATGTGGCTGGAGGACCAGCGAGAAGTGAACACCAGCGGCTTCG CTCCAGCCCGGCCCCCACCCCAGCCGGGTTCTACCACATTCTGGGCCTGGAGTGTC TTAAGGGTCCCAGCACCACCTAGCCCCCAGCCAGCCACATACACCTGTGTTGTGTC CCATGAAGATAGCAGGACCCTGCTAAATGCTTCTAGGAGTCTGGAGGTTTCCTACG TGACTGACCATT (SEQ ID NO:15).

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO:5). In some embodiments, the linker is encoded by a nucleotide sequence of GGTGGCGGAGGTTCTGGAGGTGGAGGTTCC (SEQ ID NO:16).

In one aspect, the hinge or spacer comprises a KIR2DS2 hinge.

Cytoplasmic Domain

The cytoplasmic domain or region of a CAR of the present invention includes an intracellular signaling domain. An intracellular signaling domain is generally responsible for activation of at least one of the normal effector functions of the immune cell in which the CAR has been introduced.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, CD278 (also known as "ICOS"), FcεRI, DAP10, DAP12, and CD66d. In one embodiment, a CAR of the invention comprises an intracellular signaling domain, e.g., a primary signaling domain of CD3-zeta.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Further examples of molecules containing a primary intracellular signaling domain that are of particular use in the invention include those of DAP10, DAP12, and CD32.

The intracellular signalling domain of the CAR can comprise the primary signalling domain, e.g., CD3-zeta signaling domain, by itself or it can be combined with any other desired intracellular signaling domain(s) useful in the context of a CAR of the invention. For example, the intracellular signaling domain of the CAR can comprise a primary signalling domain, e.g., CD3 zeta chain portion, and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 7. In one aspect, the signaling domain of CD3-zeta is a signaling domain of SEQ ID NO: 9 (mutant CD3zeta) or SEQ ID NO: 10 (wild type human CD3zeta).

In one aspect, the intracellular signaling domain is designed to comprise the signaling domain of CD3-zeta and the signaling domain of CD27. In one aspect, the signaling domain of CD27 comprises an amino acid sequence of QRRKYRSNKGESPVEPAEPCRYSCPREEEGSTIP-IQEDYRKPEPACSP (SEQ ID NO:8). In one aspect, the signalling domain of CD27 is encoded by a nucleic acid sequence of AGGAGTAAGAGGAGCAGGCTCCTG-CACAGTGACTACATGAACATGACTCCCCGCC GCCCGGGCCCACCCGCAAGCATTACCAGCCCTAT-GCCCCACCACGCGACTTCGCA GCCTATCGCTCC (SEQ ID NO:19).

In one aspect, the intracellular is designed to comprise the signaling domain of CD3-zeta and the signaling domain of CD28. In one aspect, the signaling domain of CD28 comprises an amino acid sequence of SEQ ID NO: 1104. In one aspect, the signaling domain of CD28 is encoded by a nucleic acid sequence of SEQ ID NO: 1105.

In one aspect, the intracellular is designed to comprise the signaling domain of CD3-zeta and the signaling domain of ICOS. In one aspect, the signaling domain of ICOS comprises an amino acid sequence of SEQ ID NO: 1106. In one aspect, the signaling domain of ICOS is encoded by a nucleic acid sequence of SEQ ID NO: 1107.

In one aspect, the CAR-expressing cell described herein can further comprise a second CAR, e.g., a second CAR that includes a different antigen binding domain, e.g., to the same target (BCMA) or a different target (e.g., CD19, CD20, or CS-1, or other multiple myeloma targets, e.g., kappa light chain, CD138, Lewis Y antigen, or CD38 (Garfall et al., Discovery Medicine, 2014, 17(91):37-46)). In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 ICOS, or OX-40, onto the first CAR, and the primary signaling domain, e.g., CD3 zeta, on the second CAR can limit the CAR activity to cells where both targets are expressed. In one embodiment, the CAR expressing cell comprises a first BCMA CAR that includes a BCMA binding domain, a transmembrane domain and a costimulatory domain and a second CAR that targets an antigen other than BCMA (e.g., an antigen expressed on leukemia or lymphoma cells, e.g., CD19, CD20, CS-1, kappa light chain, CD139, Lewis Y antigen, or CD38) and includes an antigen binding domain, a transmembrane domain and a primary signaling domain. In another embodiment, the CAR expressing cell comprises a first BCMA CAR that includes a BCMA binding domain, a transmembrane domain and a primary signaling domain and a second CAR that targets an antigen other than BCMA (e.g., an antigen expressed on leukemia or lymphoma cells, e.g., CD19, CD20, CS-1, kappa light chain, CD139, Lewis Y antigen, or CD38) and includes an antigen binding domain to the antigen, a transmembrane domain and a costimulatory signaling domain. In one embodiment, the CAR-expressing cell comprises a BCMA CAR described herein and a CAR that targets CD19 (CD19 CAR).

In one embodiment, the CAR-expressing cell comprises a BCMA CAR described herein and an inhibitory CAR. In one embodiment, the inhibitory CAR comprises an antigen binding domain that binds an antigen found on normal cells but not cancer cells, e.g., normal cells that also express mesothelin. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta.

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules include molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising a antigen binding domains that minimize such interactions, as well as methods of making and using such cells and nucleic acids. In an embodiment the antigen binding domain of one of said first said second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, the claimed invention comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

In some embodiments, the antigen binding domain of one of said first CAR said second CAR comprises an scFv, and the other comprises a single VH domain, e.g., a camelid, shark, or lamprey single VH domain, or a single VH domain derived from a human or mouse sequence. In some embodiments, the antigen binding domain of one of said first CAR said second CAR comprises an scFv, and the other comprises a nanobody. In some embodiments, the antigen binding domain of one of said first CAR said second CAR comprises comprises an scFv, and the other comprises a camelid VHH domain.

In some embodiments, when present on the surface of a cell, binding of the antigen binding domain of said first CAR to its cognate antigen is not substantially reduced by the presence of said second CAR. In some embodiments, binding of the antigen binding domain of said first CAR to its cognate antigen in the presence of said second CAR is 85%, 90%, 95%, 96%, 97%, 98% or 99% of binding of the antigen binding domain of said first CAR to its cognate antigen in the absence of said second CAR.

In some embodiments, when present on the surface of a cell, the antigen binding domains of said first CAR said second CAR, associate with one another less than if both were scFv antigen binding domains. In some embodiments, the antigen binding domains of said first CAR said second CAR, associate with one another 85%, 90%, 95%, 96%, 97%, 98% or 99% less than if both were scFv antigen binding domains.

In another aspect, the CAR-expressing cell described herein can further express another agent, e.g., an agent which enhances the activity of a CAR-expressing cell. For example, in one embodiment, the agent can be an agent which inhibits an inhibitory molecule, e.g., an agent described herein. Inhibitory molecules, e.g., PD1, can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta, or a fragment of any of these (e.g., at least a portion of an extracellular domain of any of these), and a second polypeptide which is an intracellular signaling domain described herein (e.g., comprising a costimulatory domain (e.g., 41BB, CD27 ICOS, or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). In embodiments, the CAR-expressing cell described herein comprises a switch costimulatory receptor, e.g., as described in WO 2013/019615, which is incorporated herein by reference in its entirety. PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), can be fused to a transmembrane domain and intracellular signaling domains such as 41BB and CD3 zeta (also referred to herein as a PD1 CAR). In one embodiment, the PD1 CAR, when used in combinations with a BCMA CAR described herein, improves the persistence of the CAR-expressing cell, e.g., T cell or NK cell. In one embodiment, the CAR is a PD1 CAR comprising the extracellular domain of PD1 indicated as underlined in SEQ ID NO: 24. In one embodiment, the PD1 CAR comprises the amino acid sequence of SEQ ID NO:24.

(SEQ ID NO: 24)
Malpvtalllplalllhaarppgwfldspdrpwnpptfspallvvtegdn atftcsfsntsesfvlnwyrmspsnqtdklaafpedrsqpgqdcrfrvtq lpngrdfhmsvvrarrndsgtylcgaislapkaqikeslraelrvterra evptahpspsprpagqfqtlvttttpaprpptpaptiasqplslrpeacrp aaggavhtrgldfacdiyiwaplagtcgvlllslvitlyckrgrkkllyi fkqpfmrpvqttqeedgcscrfpeeeeggcelrvkfsrsadapaykqgqn qlynelnlgrreeydvldkrrgrdpemggkprrknpqeglynelqkdkma eayseigmkgerrrgkghdglyqglstatkdtydalhmqalppr.

In one embodiment, the PD1 CAR comprises the amino acid sequence provided below (SEQ ID NO:22).

(SEQ ID NO: 22)
pqwfldspdrpwnpptfspallvvteqdnatftcsfsntsesfvlnwyrm spsnqtdklaafpedrsqpgqdcrfrvtqlpngrdfhmsvvrarrndsgt ylcgaislapkaqikeslraelryterraevptahpspsprpagqfqtlv tttpaprpptpaptiasqplslrpeacrpaaggavhtrgldfacdiyiwa plagtcgvlllslvitlyckrgrkkllyifkqpfmrpvqttqeedgcscr fpeeeeggcelrvkfsrsadapaykqgqnqlynelnlgrreeydvldkrr grdpemggkprrknpqeglynelqkdkmaeayseigmkgerrrgkghdgl yqglstatkdtydalhmqalppr.

In one embodiment, the agent comprises a nucleic acid sequence encoding the PD1 CAR, e.g., the PD1 CAR described herein. In one embodiment, the nucleic acid sequence for the PD1 CAR is shown below, with the PD1 ECD underlined below in SEQ ID NO: 23

(SEQ ID NO: 23)
atggccctccctgtcactgccctgcttctcccctcgcactcctgctcca cgccgctagacca<u>cccggatggttctggactctccggatcgcccgtgga</u>

<u>atccccaaccttctcaccggcactcttggttgtgactgagggcgataat</u>

<u>gcgaccttcacgtgctcgttctccaacacctccgaatcattcgtgctgaa</u>

<u>ctggtaccgcatgagcccgtcaaaccagaccgacaagctcgccgcgtttc</u>

<u>cggaagatcggtcgcaaccgggacaggattgtcggttccgcgtgactcaa</u>

<u>ctgccgaatggcagagacttccacatgagcgtggtccgcgctaggcgaaa</u>

<u>cgactccgggacctacctgtgcggagccatctcgctggcgcctaaggccc</u>

<u>aaatcaaagagagcttgagggccgaactgagagtgaccgagcgcagagct</u>

<u>gaggtgccaactgcacatccatcccatcgcctcggcctgcggggcagtt</u> tcagaccctggtcacgaccactccggcgccgcgcccaccgactccggccc caactatcgcgagccagccctgtcgctgaggccggaagcatgccgccct gccgccggaggtgctgtgcatacccggggattggacttcgcatgcgacat ctacatttgggctcctctcgccggaacttgtggcgtgctccttctgtccc tggtcatcaccctgtactgcaagcggggtcggaaaaagcttctgtacatt ttcaagcagcccttcatgaggcccgtgcaaaccacccaggaggaggacgg ttgctcctgccggttccccgaagaggaagaaggaggttgcgagctgcgcg -continued

```
tgaagttctcccggagcgccgacgccccgcctataagcagggccagaac cagctgtacaacgaactgaacctgggacggcgggaagagtacgatgtgct ggacaagcggcgcggccgggaccccgaaatgggcgggaagcctagaagaa agaaccctcaggaaggcctgtataacgagctgcagaaggacaagatggcc gaggcctactccgaaattgggatgaagggagagcggcggaggggaaggg gcacgacggcctgtaccaaggactgtccaccgccaccaaggacacatacg atgccctgcacatgcaggccttcccctcgc.
```

In another aspect, the present invention provides a population of CAR-expressing cells, e.g., CART cells or CAR-expressing NK cells. In some embodiments, the population of CAR-expressing cells comprises a mixture of cells expressing different CARs. For example, in one embodiment, the population of CAR-expressing cells (e.g., CART cells or CAR-expressing NK cells) can include a first cell expressing a CAR having an anti-BCMA binding domain described herein, and a second cell expressing a CAR having a different anti-BCMA binding domain, e.g., an anti-BCMA binding domain described herein that differs from the anti-BCMA binding domain in the CAR expressed by the first cell. As another example, the population of CAR-expressing cells can include a first cell expressing a CAR that includes an anti-BCMA binding domain, e.g., as described herein, and a second cell expressing a CAR that includes an antigen binding domain to a target other than BCMA (e.g., CD19, CD20, CS-1, kappa light chain, CD139, Lewis Y antigen, or CD38). In one embodiment, the population of CAR-expressing cells includes a first cell expressing a CAR comprising an anti-BCMA binding domain, e.g., as described herein, and a second cell expressing a CAR comprising an antigen binding domain that targets CD19 (CD19 CAR). In one embodiment, the population of CAR-expressing cells includes, e.g., a first cell expressing a CAR that includes a primary intracellular signaling domain, and a second cell expressing a CAR that includes a secondary signaling domain.

In another aspect, the present invention provides a population of cells wherein at least one cell in the population expresses a CAR having an anti-BCMA domain described herein, and a second cell expressing another agent, e.g., an agent which enhances the activity of a CAR-expressing cell. For example, in one embodiment, the agent can be an agent which inhibits an inhibitory molecule. Inhibitory molecules, e.g., can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta, or a fragment of any of these (e.g., at least a portion of an extracellular domain of any of these), and a second polypeptide which is an intracellular signaling domain described herein (e.g., comprising a costimulatory domain (e.g., 41BB, CD27, ICOS, or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one aspect, the present invention provides methods comprising administering a population of CAR-expressing cells (e.g., CART cells or CAR-expressing NK cells), e.g., a mixture of cells expressing different CARs, in combination with another agent, e.g., a kinase inhibitor, such as a kinase inhibitor described herein. In another aspect, the present invention provides methods comprising administering a population of cells wherein at least one cell in the population expresses a CAR having an anti-cancer associated antigen binding domain as described herein, and a second cell expressing another agent, e.g., an agent which enhances the activity of a CAR-expressing cell, in combination with another agent, e.g., a kinase inhibitor, such as a kinase inhibitor described herein.

Natural Killer Cell Receptor (NKR) CARs

In an embodiment, the CAR molecule described herein comprises one or more components of a natural killer cell receptor (NKR), thereby forming an NKR-CAR. The NKR component can be a transmembrane domain, a hinge domain, or a cytoplasmic domain from any of the following natural killer cell receptors: killer cell immunoglobulin-like receptor (KIR), e.g., KIR2DL1, KIR2DL2/L3, KIR2DL4, KIR2DL5A, KIR2DL5B, KIR2DS1, KIR2DS2, KIR2DS3, KIR2DS4, DIR2DS5, KIR3DL1/S1, KIR3DL2, KIR3DL3, KIR2DP1, and KIR3DP1; natural cyotoxicity receptor (NCR), e.g., NKp30, NKp44, NKp46; signaling lymphocyte activation molecule (SLAM) family of immune cell receptors, e.g., CD48, CD229, 2B4, CD84, NTB-A, CRACC, BLAME, and CD2F-10; Fc receptor (FcR), e.g., CD16, and CD64; and Ly49 receptors, e.g., LY49A, LY49C. The NKR-CAR molecules described herein may interact with an adaptor molecule or intracellular signaling domain, e.g., DAP12. Exemplary configurations and sequences of CAR molecules comprising NKR components are described in International Publication No. WO2014/145252, the contents of which are hereby incorporated by reference.

Strategies for Regulating Chimeric Antigen Receptors

There are many ways CAR activities can be regulated. In some embodiments, a regulatable CAR (RCAR) where the CAR activity can be controlled is desirable to optimize the safety and efficacy of a CAR therapy. For example, inducing apoptosis using, e.g., a caspase fused to a dimerization domain (see, e.g., Di et al., N Engl. J. Med. 2011 Nov. 3; 365(18):1673-1683), can be used as a safety switch in the CAR therapy of the instant invention. In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating the CAR therapy of the instant invention include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or compliment-induced cell death. For example, CAR expressing cells described herein may also express a receptor capable of being targeted by an antibody or antibody fragment. Examples of such receptors include EpCAM, VEGFR, integrins (e.g., integrins αvβ3, α4, αI3/4β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD1 1, CD1 1 a/LFA-1, CD15, CD18/ITGB2, CD19, CD20, CD22, CD23/lgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain). For example, CAR-expressing cells described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8)853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH®, a monoclonal anti-CD52 antibody that selectively binds and targets mature lymphocytes, e.g., CAR-expressing cells, for destruction, e.g., by inducing ADCC. In other embodiments, CAR-expressing cells can be selectively targeted using a CAR ligand, e.g., an anti-idiotypic antibody. In some embodiments, the anti-idiotypic antibody can cause effector cell activity, e.g, ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In some embodiments, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. Additional description and exemplary configurations of such regulatable CARs are provided herein and in International Publiciation No. WO 2015/090229, hereby incorporated by reference in its entirety.

In an embodiment, an RCAR comprises two polypeptides or members: 1) an intracellular signaling member comprising an intracellular signaling domain, e.g., a primary intracellular signaling domain described herein, and a first switch domain; 2) an antigen binding member comprising an antigen binding domain, e.g., that targets a tumor antigen described herein, as described herein and a second switch domain. Optionally, the RCAR comprises a transmembrane domain described herein. In an embodiment, a transmembrane domain can be disposed on the intracellular signaling member, on the antigen binding member, or on both. (Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to a intracellular signaling domain can be different, e.g., reversed).

In an embodiment, the first and second switch domains can form an intracellular or an extracellular dimerization switch. In an embodiment, the dimerization switch can be a homodimerization switch, e.g., where the first and second switch domain are the same, or a heterodimerization switch, e.g., where the first and second switch domain are different from one another.

In embodiments, an RCAR can comprise a "multi switch." A multi switch can comprise heterodimerization switch domains or homodimerization switch domains. A multi switch comprises a plurality of, e.g., 2, 3, 4, 5, 6, 7, 8, 9, or 10, switch domains, independently, on a first member, e.g., an antigen binding member, and a second member, e.g., an intracellular signaling member. In an embodiment, the first member can comprise a plurality of first switch domains, e.g., FKBP-based switch domains, and the second member can comprise a plurality of second switch domains, e.g., FRB-based switch domains. In an embodiment, the first member can comprise a first and a second switch domain, e.g., a FKBP-based switch domain and a FRB-based switch domain, and the second member can comprise a first and a second switch domain, e.g., a FKBP-based switch domain and a FRB-based switch domain.

In an embodiment, the intracellular signaling member comprises one or more intracellular signaling domains, e.g., a primary intracellular signaling domain and one or more costimulatory signaling domains.

In an embodiment, the antigen binding member may comprise one or more intracellular signaling domains, e.g., one or more costimulatory signaling domains. In an embodiment, the antigen binding member comprises a plurality, e.g., 2 or 3 costimulatory signaling domains described herein, e.g., selected from 4-1BB, CD28, CD27, ICOS, and OX40, and in embodiments, no primary intracellular signaling domain. In an embodiment, the antigen binding member comprises the following costimulatory signaling domains, from the extracellular to intracellular direction: 4-1BB-CD27; 4-1BB-CD27; CD27-4-1BB; 4-1BB-CD28; CD28-4-1BB; OX40-CD28; CD28-OX40; CD28-4-1BB; or 4-1BB-CD28. In such embodiments, the intracellular binding member comprises a CD3zeta domain. In one such embodiment the RCAR comprises (1) an antigen binding member comprising, an antigen binding domain, a transmembrane domain, and two costimulatory domains and a first switch domain; and (2) an intracellular signaling domain comprising a transmembrane domain or membrane tethering domain and at least one primary intracellular signaling domain, and a second switch domain.

An embodiment provides RCARs wherein the antigen binding member is not tethered to the surface of the CAR cell. This allows a cell having an intracellular signaling member to be conveniently paired with one or more antigen binding domains, without transforming the cell with a sequence that encodes the antigen binding member. In such embodiments, the RCAR comprises: 1) an intracellular signaling member comprising: a first switch domain, a transmembrane domain, an intracellular signaling domain, e.g., a primary intracellular signaling domain, and a first switch domain; and 2) an antigen binding member comprising: an antigen binding domain, and a second switch domain, wherein the antigen binding member does not comprise a transmembrane domain or membrane tethering domain, and, optionally, does not comprise an intracellular signaling domain. In some embodiments, the RCAR may further comprise 3) a second antigen binding member comprising: a second antigen binding domain, e.g., a second antigen binding domain that binds a different antigen than is bound by the antigen binding domain; and a second switch domain.

Also provided herein are RCARs wherein the antigen binding member comprises bispecific activation and targeting capacity. In this embodiment, the antigen binding member can comprise a plurality, e.g., 2, 3, 4, or 5 antigen binding domains, e.g., scFvs, wherein each antigen binding domain binds to a target antigen, e.g. different antigens or the same antigen, e.g., the same or different epitopes on the same antigen. In an embodiment, the plurality of antigen binding domains are in tandem, and optionally, a linker or hinge region is disposed between each of the antigen binding domains. Suitable linkers and hinge regions are described herein.

An embodiment provides RCARs having a configuration that allows switching of proliferation. In this embodiment, the RCAR comprises: 1) an intracellular signaling member comprising: optionally, a transmembrane domain or membrane tethering domain; one or more co-stimulatory signaling domain, e.g., selected from 4-1BB, CD28, CD27, ICOS, and OX40, and a switch domain; and 2) an antigen binding member comprising: an antigen binding domain, a transmembrane domain, and a primary intracellular signaling domain, e.g., a CD3zeta domain, wherein the antigen binding member does not comprise a switch domain, or does not comprise a switch domain that dimerizes with a switch domain on the intracellular signaling member. In an embodiment, the antigen binding member does not comprise a co-stimulatory signaling domain. In an embodiment, the intracellular signaling member comprises a switch domain from a homodimerization switch. In an embodiment, the intracellular signaling member comprises a first switch domain of a heterodimerization switch and the RCAR comprises a second intracellular signaling member which comprises a second switch domain of the heterodimerization switch. In such embodiments, the second intracellular signaling member comprises the same intracellular signaling domains as the intracellular signaling member. In an embodiment, the dimerization switch is intracellular. In an embodiment, the dimerization switch is extracellular.

In any of the RCAR configurations described here, the first and second switch domains comprise a FKBP-FRB based switch as described herein.

Also provided herein are cells comprising an RCAR described herein. Any cell that is engineered to express a RCAR can be used as a RCARX cell. In an embodiment the RCARX cell is a T cell, and is referred to as a RCART cell. In an embodiment the RCARX cell is an NK cell, and is referred to as a RCARN cell.

Also provided herein are nucleic acids and vectors comprising RCAR encoding sequences. Sequence encoding various elements of an RCAR can be disposed on the same nucleic acid molecule, e.g., the same plasmid or vector, e.g., viral vector, e.g., lentiviral vector. In an embodiment, (i) sequence encoding an antigen binding member and (ii) sequence encoding an intracellular signaling member, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In an embodiment, a first promoter is operably linked to (i) and a second promoter is operably linked to (ii), such that (i) and (ii) are transcribed as separate mRNAs.

Alternatively, the sequence encoding various elements of an RCAR can be disposed on the different nucleic acid molecules, e.g., different plasmids or vectors, e.g., viral vector, e.g., lentiviral vector. E.g., the (i) sequence encoding an antigen binding member can be present on a first nucleic acid, e.g., a first vector, and the (ii) sequence encoding an intracellular signaling member can be present on the second nucleic acid, e.g., the second vector.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB, -based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) *Identification of an 11-kDa FKBP12-rapamycin-binding domain within the 289-kDa FKBP12-rapamycin-associated protein and characterization of a critical serine residue*. Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is as follows:

```
                                     (SEQ ID NO: 275)
D V P D Y A S L G G P S S P K K K R K V S R G V Q
V E T I S P G D G R T F P K R G Q T C V V H Y T G
M L E D G K K F D S S R D R N K P F K F M L G K Q
E V I R G W E E G V A Q M S V G Q R A K L T I S P
D Y A Y G A T G H P G I I P P H A T L V F D V E L
L K L E T S Y
```

In embodiments, an FKBP switch domain can comprise a fragment of FKBP having the ability to bind with FRB, or a fragment or analog thereof, in the presence of rapamycin or a rapalog, e.g., the underlined portion of SEQ ID NO: 275, which is:

```
                                     (SEQ ID NO: 276)
V Q V E T I S P G D G R T F P K R G Q T C V V H Y
T G M L E D G K K F D S S R D R N K P F K F M L G
K Q E V I R G W E E G V A Q M S V G Q R A K L T I
S P D Y A Y G A T G H P G I I P P H A T L V F D V
E L L K L E T S
```

The amino acid sequence of FRB is as follows:

```
                                     (SEQ ID NO: 277)
ILWHEMWHEG LEEASRLYFG ERNVKGMFEV LEPLHAMMER
GPQTLKETSF NQAYGRDLME AQEWCRKYMK SGNVKDLTQA
WDLYYHVFRR ISK
```

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 275 or 276; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 277. In an embodiment, a RCAR described herein comprises one switch domain comprises amino acid residues disclosed in SEQ ID NO: 275 (or SEQ ID NO: 276), and one switch domain comprises amino acid residues disclosed in SEQ ID NO: 277.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, S2035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 278, or leucine (E2032L), e.g., SEQ ID NO: 279. In an embodiment, a mutant FRB comprises a mutation at T2098, where T2098 is mutated to phenylalanine (T2098F) or leucine (T2098L), e.g., SEQ ID NO: 280. In an embodiment, a mutant FRB comprises a mutation at E2032 and at T2098, where E2032 is mutated to any amino acid, and where T2098 is mutated to any amino acid, e.g., SEQ ID NO: 281. In an embodiment, a mutant FRB comprises an E2032I and a T2098L mutation, e.g., SEQ ID NO: 282. In an embodiment, a mutant FRB comprises an E2032L and a T2098L mutation, e.g., SEQ ID NO: 283.

TABLE 11

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHAMMERGPQTLKETSFNQAYGR DLMEAQEWCRKYMKSGNVKDLTQAWDLYYHVFRRISKTS | 78 |
| E2032L mutant | ILWHEMWHEGLLEASRLYFGERNVKGMFEVLEPLHAMMERGPQTLKETSFNQAYGR DLMEAQEWCRKYMKSGNVKDLTQAWDLYYHVFRRISKTS | 79 |
| T2098L mutant | ILWHEMWHEGLEEASRLYFGERNVKGMFEVLEPLHAMMERGPQTLKETSFNQAYGR DLMEAQEWCRKYMKSGNVKDLLQAWDLYYHVFRRISKTS | 80 |
| E2032, T2098 mutant | ILWHEMWHEGLXEASRLYFGERNVKGMFEVLEPLHAMMERGPQTLKETSFNQAYGR DLMEAQEWCRKYMKSGNVKDLXQAWDLYYHVFRRISKTS | 81 |
| E2032I, T2098L mutant | ILWHEMWHEGLIEASRLYFGERNVKGMFEVLEPLHAMMERGPQTLKETSFNQAYGR DLMEAQEWCRKYMKSGNVKDLLQAWDLYYHVFRRISKTS | 82 |
| E2032L, T2098L mutant | ILWHEMWHEGLLEASRLYFGERNVKGMFEVLEPLHAMMERGPQTLKETSFNQAYGR DLMEAQEWCRKYMKSGNVKDLLQAWDLYYHVFRRISKTS | 83 |

Other suitable dimerization switches include a GyrB-GyrB based dimerization switch, a Gibberellin-based dimerization switch, a tag/binder dimerization switch, and a halo-tag/snap-tag dimerization switch. Following the guidance provided herein, such switches and relevant dimerization molecules will be apparent to one of ordinary skill.

Dimerization Molecule

Association between the switch domains is promoted by the dimerization molecule. In the presence of dimerization molecule interaction or association between switch domains allows for signal transduction between a polypeptide associated with, e.g., fused to, a first switch domain, and a polypeptide associated with, e.g., fused to, a second switch domain. In the presence of non-limiting levels of dimerization molecule signal transduction is increased by 1.1, 1.2, 1.3, 1.4, 1.5, 1.6, 1.7, 1.8, 1.9, 2, 5, 10, 50, 100 fold, e.g., as measured in a system described herein.

Rapamycin and rapamycin analogs (sometimes referred to as rapalogues), e.g., RAD001, can be used as dimerization molecules in a FKBP/FRB-based dimerization switch described herein. In an embodiment the dimerization molecule can be selected from rapamycin (sirolimus), RAD001 (everolimus), zotarolimus, temsirolimus, AP-23573 (ridaforolimus), biolimus and AP21967. Additional rapamycin analogs suitable for use with FKBP/FRB-based dimerization switches are further described in the section entitled "Combination Therapies", or in the subsection entitled "Combination with a Low, Immune Enhancing, Dose of an mTOR inhibitor".

Split CAR

In some embodiments, the CAR-expressing cell uses a split CAR. The split CAR approach is described in more detail in publications WO2014/055442 and WO2014/055657, incorporated herein by reference. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens. In embodiments the first antigen binding domain recognizes BCMA, e.g., comprises an antigen binding domain described herein, and the second antigen binding domain recognizes an antigen expressed on acute myeloid leukemia cells, e.g., CD123, CLL-1, CD34, FLT3, or folate receptor beta. In embodiments the first antigen binding domain recognizes BCMA, e.g., comprises an antigen binding domain described herein, and the second antigen binding domain recognizes an antigen expressed on B-cells, e.g., CD10, CD19, CD20, CD22, CD34, CD123, FLT-3, ROR1, CD79b, CD179b, or CD79a.

Stability and Mutations

The stability of an anti-BCMA binding domain, e.g., scFv molecules (e.g., soluble scFv) can be evaluated in reference to the biophysical properties (e.g., thermal stability) of a conventional control scFv molecule or a full length antibody. In one embodiment, the humanized scFv has a thermal stability that is greater than about 0.1, about 0.25, about 0.5, about 0.75, about 1, about 1.25, about 1.5, about 1.75, about 2, about 2.5, about 3, about 3.5, about 4, about 4.5, about 5, about 5.5, about 6, about 6.5, about 7, about 7.5, about 8, about 8.5, about 9, about 9.5, about 10 degrees, about 11 degrees, about 12 degrees, about 13 degrees, about 14 degrees, or about 15 degrees Celsius than a control binding molecule (e.g. a conventional scFv molecule) in the described assays.

The improved thermal stability of the anti-BCMA binding domain, e.g., scFv is subsequently conferred to the entire CART-BCMA construct, leading to improved therapeutic properties of the CART-BCMA construct. The thermal stability of the anti-BCMA binding domain, e.g., scFv can be improved by at least about 2° C. or 3° C. as compared to a conventional antibody. In one embodiment, the anti-BCMA binding domain, e.g., scFv has a 1° C. improved thermal stability as compared to a conventional antibody. In another embodiment, the anti-BCMA binding domain, e.g., scFv has a 2° C. improved thermal stability as compared to a conventional antibody. In another embodiment, the scFv has a 4, 5, 6, 7, 8, 9, 10, 11, 12, 13, 14, 15° C. improved thermal stability as compared to a conventional antibody. Comparisons can be made, for example, between the scFv molecules disclosed herein and scFv molecules or Fab fragments of an antibody from which the scFv VH and VL were derived. Thermal stability can be measured using methods known in the art. For example, in one embodiment, Tm can be measured. Methods for measuring Tm and other methods of determining protein stability are described in more detail below.

Mutations in scFv (arising through humanization or direct mutagenesis of the soluble scFv) alter the stability of the scFv and improve the overall stability of the scFv and the CART33 construct. Stability of the human scFv can be compared against the murine scFv using measurements such as Tm, temperature denaturation and temperature aggregation.

The binding capacity of the mutant scFvs can be determined using assays described in the Examples.

In one embodiment, the anti-BCMA binding domain, e.g., scFv comprises at least one mutation arising from the humanization process such that the mutated scFv confers improved stability to the CART-BCMA construct. In another embodiment, the anti-BCMA binding domain, e.g., scFv comprises at least 1, 2, 3, 4, 5, 6, 7, 8, 9, 10 mutations arising from the humanization process such that the mutated scFv confers improved stability to the CART-BCMA construct.

Methods of Evaluating Protein Stability

The stability of an antigen binding domain may be assessed using, e.g., the methods described below. Such methods allow for the determination of multiple thermal unfolding transitions where the least stable domain either unfolds first or limits the overall stability threshold of a multidomain unit that unfolds cooperatively (e.g., a multidomain protein which exhibits a single unfolding transition). The least stable domain can be identified in a number of additional ways. Mutagenesis can be performed to probe which domain limits the overall stability. Additionally, protease resistance of a multidomain protein can be performed under conditions where the least stable domain is known to be intrinsically unfolded via DSC or other spectroscopic methods (Fontana, et al., (1997) Fold. Des., 2: R17-26; Dimasi et al. (2009) J. Mol. Biol. 393: 672-692). Once the least stable domain is identified, the sequence encoding this domain (or a portion thereof) may be employed as a test sequence in the methods.

a) Thermal Stability

The thermal stability of the compositions may be analyzed using a number of non-limiting biophysical or biochemical techniques known in the art. In certain embodiments, thermal stability is evaluated by analytical spectroscopy.

An exemplary analytical spectroscopy method is Differential Scanning calorimetry (DSC). DSC employs a calorimeter which is sensitive to the heat absorbances that accompany the unfolding of most proteins or protein domains (see, e.g. Sanchez-Ruiz, et al., Biochemistry, 27: 1648-52, 1988). To determine the thermal stability of a protein, a sample of the protein is inserted into the calorimeter and the temperature is raised until the Fab or scFv unfolds. The temperature at which the protein unfolds is indicative of overall protein stability.

Another exemplary analytical spectroscopy method is Circular Dichroism (CD) spectroscopy. CD spectrometry measures the optical activity of a composition as a function of increasing temperature. Circular dichroism (CD) spectroscopy measures differences in the absorption of left-handed polarized light versus right-handed polarized light which arise due to structural asymmetry. A disordered or unfolded structure results in a CD spectrum very different from that of an ordered or folded structure. The CD spectrum reflects the sensitivity of the proteins to the denaturing effects of increasing temperature and is therefore indicative of a protein's thermal stability (see van Mierlo and Steemsma, J. Biotechnol., 79(3):281-98, 2000).

Another exemplary analytical spectroscopy method for measuring thermal stability is Fluorescence Emission Spectroscopy (see van Mierlo and Steemsma, supra). Yet another exemplary analytical spectroscopy method for measuring thermal stability is Nuclear Magnetic Resonance (NMR) spectroscopy (see, e.g. van Mierlo and Steemsma, supra).

The thermal stability of a composition can be measured biochemically. An exemplary biochemical method for assessing thermal stability is a thermal challenge assay. In a "thermal challenge assay", a composition is subjected to a range of elevated temperatures for a set period of time. For example, in one embodiment, test scFv molecules or molecules comprising scFv molecules are subject to a range of increasing temperatures, e.g., for 1-1.5 hours. The activity of the protein is then assayed by a relevant biochemical assay. For example, if the protein is a binding protein (e.g. an scFv or scFv-containing polypeptide) the binding activity of the binding protein may be determined by a functional or quantitative ELISA.

Such an assay may be done in a high-throughput format and those disclosed in the Examples using E. coli and high throughput screening. A library of anti-BCMA binding domain, e.g., scFv variants may be created using methods known in the art. Anti-BCMA binding domain, e.g., scFv expression may be induced and the anti-BCMA binding domain, e.g., scFv may be subjected to thermal challenge. The challenged test samples may be assayed for binding and those anti-BCMA binding domain, e.g., scFvs which are stable may be scaled up and further characterized.

Thermal stability is evaluated by measuring the melting temperature (Tm) of a composition using any of the above techniques (e.g. analytical spectroscopy techniques). The melting temperature is the temperature at the midpoint of a thermal transition curve wherein 50% of molecules of a composition are in a folded state (See e.g., Dimasi et al. (2009) J. Mol Biol. 393: 672-692). In one embodiment, Tm values for an anti-BCMA binding domain, e.g., scFv are about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an IgG is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an multivalent antibody is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C.

Thermal stability is also evaluated by measuring the specific heat or heat capacity (Cp) of a composition using an analytical calorimetric technique (e.g. DSC). The specific heat of a composition is the energy (e.g. in kcal/mol) is required to rise by 1° C., the temperature of 1 mol of water. As large Cp is a hallmark of a denatured or inactive protein composition. The change in heat capacity (ΔCp) of a composition is measured by determining the specific heat of a composition before and after its thermal transition. Thermal stability may also be evaluated by measuring or determining other parameters of thermodynamic stability including Gibbs free energy of unfolding (ΔG), enthalpy of unfolding (ΔH), or entropy of unfolding (ΔS). One or more of the above biochemical assays (e.g. a thermal challenge assay) are used to determine the temperature (i.e. the $T_C$ value) at which 50% of the composition retains its activity (e.g. binding activity).

In addition, mutations to the anti-BCMA binding domain, e.g., scFv alter the thermal stability of the anti-BCMA binding domain, e.g., scFv compared with the unmutated anti-BCMA binding domain, e.g., scFv. When the human or humanized anti-BCMA binding domain, e.g., scFv is incorporated into a BCMA construct, the anti-BCMA binding domain, e.g., humanized scFv confers thermal stability to the overall anti-BCMA CART construct. In one embodiment, the anti-BCMA binding domain, e.g., scFv comprises a single mutation that confers thermal stability to the anti-BCMA binding domain, e.g., scFv. In another embodiment, the anti-BCMA binding domain, e.g., scFv comprises multiple mutations that confer thermal stability to the anti-BCMA binding domain, e.g., scFv. In one embodiment, the multiple mutations in the anti-BCMA binding domain, e.g., scFv have an additive effect on thermal stability of the anti-BCMA binding domain, e.g., scFv.

b) % Aggregation

The stability of a composition can be determined by measuring its propensity to aggregate. Aggregation can be measured by a number of non-limiting biochemical or biophysical techniques. For example, the aggregation of a composition may be evaluated using chromatography, e.g. Size-Exclusion Chromatography (SEC). SEC separates molecules on the basis of size. A column is filled with semi-solid beads of a polymeric gel that will admit ions and small molecules into their interior but not large ones. When a protein composition is applied to the top of the column, the compact folded proteins (i.e. non-aggregated proteins) are distributed through a larger volume of solvent than is available to the large protein aggregates. Consequently, the large aggregates move more rapidly through the column, and in this way the mixture can be separated or fractionated into its components. Each fraction can be separately quantified (e.g. by light scattering) as it elutes from the gel. Accordingly, the % aggregation of a composition can be determined by comparing the concentration of a fraction with the total concentration of protein applied to the gel. Stable compositions elute from the column as essentially a single fraction and appear as essentially a single peak in the elution profile or chromatogram.

c) Binding Affinity

The stability of a composition can be assessed by determining its target binding affinity. A wide variety of methods for determining binding affinity are known in the art. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson, U., et al. (1993) Ann. Biol. Clin. 51:19-26; Jonsson, U., i (1991) Biotechniques 11:620-627; Johnsson, B., et al. (1995) J. Mol. Recognit. 8:125-131; and Johnnson, B., et al. (1991) Anal. Biochem. 198:268-277.

In one aspect, the antigen binding domain of the CAR comprises an amino acid sequence that is homologous to an antigen binding domain amino acid sequence described herein, and the antigen binding domain retains the desired functional properties of the anti-BCMA antibody fragments described herein. In one specific aspect, the CAR composition of the invention comprises an antibody fragment. In a further aspect, that antibody fragment comprises an scFv.

In various aspects, the antigen binding domain of the CAR is engineered by modifying one or more amino acids within one or both variable regions (e.g., VH and/or VL), for example within one or more CDR regions and/or within one or more framework regions. In one specific aspect, the CAR composition of the invention comprises an antibody fragment. In a further aspect, that antibody fragment comprises a scFv.

It will be understood by one of ordinary skill in the art that the antibody or antibody fragment of the invention may further be modified such that they vary in amino acid sequence (e.g., from wild-type), but not in desired activity. For example, additional nucleotide substitutions, e.g., conservative substitutions leading to amino acid substitutions, e.g., conservative substitutions at "non-essential" amino acid residues may be made to the protein For example, a nonessential amino acid residue in a molecule may be replaced with another amino acid residue from the same side chain family. In another embodiment, a string of amino acids can be replaced with a structurally similar string that differs in order and/or composition of side chain family members, e.g., a conservative substitution, in which an amino acid residue is replaced with an amino acid residue having a similar side chain, may be made.

Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Percent identity in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at gcg.com), using either a Blossom 62 matrix or a PAM250 matrix, and a gap weight of 16, 14, 12, 10, 8, 6, or 4 and a length weight of 1, 2, 3, 4, 5, or 6.

In one aspect, the present invention contemplates modifications of the starting antibody or fragment (e.g., scFv) amino acid sequence that generate functionally equivalent molecules. For example, the VH or VL of an anti-BCMA binding domain, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the anti-BCMA binding domain, e.g., scFv. The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct.

RNA Transfection

Disclosed herein are methods for producing an in vitro transcribed RNA CAR. The present invention also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:35). RNA so produced can efficiently transfect different kinds of cells. In one aspect, the template includes sequences for the CAR.

In one aspect the anti-BCMA CAR is encoded by a messenger RNA (mRNA). In one aspect the mRNA encoding the anti-BCMA CAR is introduced into an immune effector cell, e.g., a T cell or a NK cell, for production of a CAR-expressing cell (e.g., CART cell or CAR-expressing NK cell).

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR of the present invention. For example, the template for the RNA CAR comprises an extracellular region comprising a single chain variable domain of an anti-tumor antibody; a hinge region, a transmembrane domain (e.g., a transmembrane domain of CD8a); and a cytoplasmic region that includes an intracellular signaling domain, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 31) (size can be 50-5000 T (SEQ ID NO: 32)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 33).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 34) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Nucleic Acid Constructs Encoding a CAR

The present invention also provides nucleic acid molecules encoding one or more CAR constructs described herein. In one aspect, the nucleic acid molecule is provided as a messenger RNA transcript. In one aspect, the nucleic acid molecule is provided as a DNA construct.

Accordingly, in one aspect, the invention pertains to an isolated nucleic acid molecule encoding a chimeric antigen receptor (CAR), wherein the CAR comprises a anti-BCMA binding domain (e.g., a human anti-BCMA binding domain), a transmembrane domain, and an intracellular signaling domain comprising a stimulatory domain, e.g., a costimulatory signaling domain and/or a primary signaling domain, e.g., zeta chain. In one embodiment, the anti-BCMA binding domain is an anti-BCMA binding domain described herein, e.g., an anti-BCMA binding domain which comprises a sequence selected from a group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO:144, SEQ ID NO:145, SEQ ID NO:146, SEQ ID NO:147, SEQ ID NO:148 or SEQ ID NO:149, or a sequence with 95-99% identify thereof. In one embodiment, the transmembrane domain is transmembrane domain of a protein selected from the group consisting of the alpha, beta or zeta chain of the T-cell receptor, CD28, CD3 epsilon, CD45, CD4, CDS, CD8, CD9, CD16, CD22, CD33, CD37, CD64, CD80, CD86, CD134, CD137 and CD154. In one embodiment, the transmembrane domain comprises a sequence of SEQ ID NO: 6, or a sequence with 95-99% identity thereof. In one embodiment, the anti-BCMA binding domain is connected to the transmembrane domain by a hinge region, e.g., a hinge described herein. In one embodiment, the hinge region comprises SEQ ID NO:2 or SEQ ID NO:3 or SEQ ID NO:4 or SEQ ID NO:5, or a sequence with 95-99% identity thereof. In one embodiment, the isolated nucleic acid molecule further comprises a sequence encoding a costimulatory domain. In one embodiment, the costimulatory domain is a functional signaling domain of a protein selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In one embodiment, the costimulatory domain comprises a sequence of SEQ ID NO:7, or a sequence with 95-99% identity thereof or a CD27 costimulatory domain having a sequence of SEQ ID NO:8 (or a sequence with 95-99% identity thereof) or a CD28 costimulatory domain having a sequence of SEQ ID NO:379 (or a sequence with 95-99% identity thereof) or a ICOS costimulatory domain having a sequence of SEQ ID NO: 381 (or a sequence with 95-99% identity thereof). In one embodiment, the intracellular signaling domain comprises a functional signaling domain of 4-1BB and a functional signaling domain of CD3 zeta. In one embodiment, the intracellular signaling domain comprises the sequence of SEQ ID NO: 7 or SEQ ID NO: 8, or a sequence with 95-99% identity thereof, and the sequence of SEQ ID NO: 9 or SEQ ID NO:10, or a sequence with 95-99% identity thereof, wherein the sequences comprising the intracellular signaling domain are expressed in the same frame and as a single polypeptide chain.

In another aspect, the invention pertains to an isolated nucleic acid molecule encoding a CAR construct comprising a leader sequence of SEQ ID NO: 1, a scFv domain having a sequence selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO:144, SEQ ID NO:145, SEQ ID NO:146, SEQ ID NO:147, SEQ ID NO:148 or SEQ ID NO:149 (or a sequence with 95-99% identify thereof), a hinge region of SEQ ID NO:2 or SEQ ID NO:3 or SEQ ID NO:4 or SEQ ID NO:5 (or a sequence with 95-99% identity thereof), a transmembrane domain having a sequence of SEQ ID NO: 6 (or a sequence with 95-99% identity thereof), a 4-1BB costimulatory domain having a sequence of SEQ ID NO:7 or a CD27 costimulatory domain having a sequence of SEQ ID NO:8 (or a sequence with 95-99% identity thereof) or a CD28 costimulatory domain having a sequence of SEQ ID NO:1104 (or a sequence with 95-99% identity thereof) or a ICOS costimulatory domain having a sequence of SEQ ID NO: 1106 (or a sequence with 95-99% identity thereof), and a CD3 zeta stimulatory domain having a sequence of SEQ ID NO:9 or SEQ ID NO:10 (or a sequence with 95-99% identity thereof).

In another aspect, the invention pertains to an isolated polypeptide molecule encoded by the nucleic acid molecule. In one embodiment, the isolated polypeptide molecule comprises a sequence selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO:144, SEQ ID NO:145, SEQ ID NO:146, SEQ ID NO:147, SEQ ID NO:148 and SEQ ID NO:149, or a sequence with 95-99% identify thereof.

In another aspect, the invention pertains to a nucleic acid molecule encoding a chimeric antigen receptor (CAR) molecule that comprises an anti-BCMA binding domain, a transmembrane domain, and an intracellular signaling domain comprising a stimulatory domain, and wherein said anti-BCMA binding domain comprises a sequence selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO:144, SEQ ID NO:145, SEQ ID NO:146, SEQ ID NO:147, SEQ ID NO:148 and SEQ ID NO:149, or a sequence with 95-99% identify thereof.

In one embodiment, the encoded CAR molecule further comprises a sequence encoding a costimulatory domain. In one embodiment, the costimulatory domain is a functional signaling domain of a protein, e.g., described herein, e.g., selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In one embodiment, the costimulatory domain comprises a sequence of SEQ ID NO:7. In one embodiment, the transmembrane domain is a transmembrane domain of a protein, e.g., described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the transmembrane domain comprises a sequence of SEQ ID NO:6. In one embodiment, the intracellular signaling domain comprises a functional signaling domain of 4-1BB and a functional signaling domain of zeta. In one embodiment, the intracellular signaling domain comprises the sequence of SEQ ID NO: 7 and the sequence of SEQ ID NO: 9, wherein the sequences comprising the intracellular signaling domain are expressed in the same frame and as a single polypeptide chain. In one embodiment, the anti-BCMA binding domain is connected to the transmembrane domain by a hinge region. In one embodiment, the hinge region comprises SEQ ID NO:2. In one embodiment, the hinge region comprises SEQ ID NO:3 or SEQ ID NO:4 or SEQ ID NO:5.

In another aspect, the invention pertains to an encoded CAR molecule comprising a leader sequence of SEQ ID NO: 1, a scFv domain having a sequence selected from the group consisting of SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO:144, SEQ ID NO:145, SEQ ID NO:146, SEQ ID NO:147, SEQ ID NO:148 and SEQ ID NO:149, or a sequence with 95-99% identify thereof, a hinge region of SEQ ID NO:2 or SEQ ID NO:3 or SEQ ID NO:4 or SEQ ID NO:5, a transmembrane domain having a sequence of SEQ ID NO: 6, a 4-1BB costimulatory domain having a sequence of SEQ ID NO:7, or a CD27 costimulatory domain having a sequence of SEQ ID NO:8, or a CD28 costimulatory domain having a sequence of SEQ ID NO:1104 (or a sequence with 95-99% identity thereof) or a ICOS costimulatory domain having a sequence of SEQ ID NO: 1106 (or a sequence with 95-99% identity thereof), and a CD3 zeta stimulatory domain having a sequence of SEQ ID NO:9 or SEQ ID NO:10. In one embodiment, the encoded CAR molecule comprises a sequence selected from a group consisting of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, and SEQ ID NO: 233 or a sequence with 95-99% identify thereof.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (Ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, CRISPR, CAS9, and zinc finger nucleases. See below June et al. 2009 *Nature Reviews Immunology* 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

An example of a promoter that is capable of expressing a CAR transgene in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., Mol. Ther. 17(8): 1453-1464 (2009). In one aspect, the EF1a promoter comprises the sequence provided as SEQ ID NO:11.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

```
WT PGK Promoter
                                 (SEQ ID NO: 1109)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCGCGCGGCGACGCAAAGGGCCTTGGTGCGGT

CTCGTCGGCGCAGGGACGCGTTTGGGTCCCGACGGAACCTTTTCCGCGTT

GGGGTTGGGGCACCATAAGCT

Exemplary truncated PGK Promoters:
PGK100:
                                 (SEQ ID NO: 1110)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTG

PGK200:
                                 (SEQ ID NO: 1111)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACG

PGK300:
                                 (SEQ ID NO: 1112)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCG

PGK400:
                                 (SEQ ID NO: 1113)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCG
```

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In one embodiment, the vector can further comprise a nucleic acid encoding a second CAR. In one embodiment, the second CAR includes an antigen binding domain to a target expressed on acute myeloid leukemia cells, such as, e.g., CD123, CD34, CLL-1, folate receptor beta, or FLT3; or a target expressed on a B cell, e.g., CD10, CD19, CD20, CD22, CD34, CD123, FLT-3, ROR1, CD79b, CD179b, or CD79a. In one embodiment, the vector comprises a nucleic acid sequence encoding a first CAR that specifically binds a first antigen and includes an intracellular signaling domain having a costimulatory signaling domain but not a primary signaling domain, and a nucleic acid encoding a second CAR that specifically binds a second, different, antigen and includes an intracellular signaling domain having a primary signaling domain but not a costimulatory signaling domain. In one embodiment, the vector comprises a nucleic acid encoding a first BCMA CAR that includes a BCMA binding domain, a transmembrane domain and a costimulatory domain and a nucleic acid encoding a second CAR that targets an antigen other than BCMA (e.g., an antigen expressed on AML cells, e.g., CD123, CD34, CLL-1, folate receptor beta, or FLT3; or an antigen expressed on a B cell, e.g., CD10, CD19, CD20, CD22, CD34, CD123, FLT-3, ROR1, CD79b, CD179b, or CD79a) and includes an antigen binding domain, a transmembrane domain and a primary signaling domain. In another embodiment, the vector comprises a nucleic acid encoding a first BCMA CAR that includes a BCMA binding domain, a transmembrane domain and a primary signaling domain and a nucleic acid encoding a second CAR that specifically binds an antigen other than BCMA (e.g., an antigen expressed on AML cells, e.g., CD123, CD34, CLL-1, folate receptor beta, or FLT3; or an antigen expressed on a B cell, e.g., CD10, CD19, CD20, CD22, CD34, CD123, FLT-3, ROR1, CD79b, CD179b, or CD79a) and includes an antigen binding domain to the antigen, a transmembrane domain and a costimulatory signaling domain.

In one embodiment, the vector comprises a nucleic acid encoding a BCMA CAR described herein and a nucleic acid encoding an inhibitory CAR. In one embodiment, the inhibitory CAR comprises an antigen binding domain that binds an antigen found on normal cells but not cancer cells, e.g., normal cells that also express BCMA. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta.

In embodiments, the vector may comprise two or more nucleic acid sequences encoding a CAR, e.g., a BCMA CAR described herein and a second CAR, e.g., an inhibitory CAR or a CAR that specifically binds to an antigen other than BCMA (e.g., an antigen expressed on AML cells, e.g., CD123, CLL-1, CD34, FLT3, or folate receptor beta; or antigen expresson B cells, e.g., CD10, CD19, CD20, CD22, CD34, CD123, FLT-3, ROR1, CD79b, CD179b, or CD79a). In such embodiments, the two or more nucleic acid sequences encoding the CAR are encoded by a single nucleic acid molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include the following, wherein the GSG residues are optional:

T2A:
(SEQ ID NO: 1114)
(GSG) E G R G S L L T C G D V E E N P G P

P2A:
(SEQ ID NO: 1115)
(GSG) A T N F S L L K Q A G D V E E N P G P

E2A:
(SEQ ID NO: 1116)
(GSG) Q C T N Y A L L K L A G D V E S N P G P

F2A:
(SEQ ID NO: 1117)
(GSG) V K Q T L N F D L L K L A G D V E S N P G P

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., a T cell or NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian T cells or NK cells. In one aspect, the mammalian T cell is a human T cell. In one aspect, the mammalian NK cell is a human NK cell.

Sources of Cells

Prior to expansion and genetic modification, a source of cells, e.g., immune effector cells (e.g., T cells or NK cells), is obtained from a subject. The term "subject" is intended to include living organisms in which an immune response can be elicited (e.g., mammals). Examples of subjects include humans, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In certain aspects of the present invention, any number of immune effector cell (e.g., T cell or NK cell) lines available in the art, may be used. In certain aspects of the present invention, T cells can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and to place the cells in an appropriate buffer or media for subsequent processing steps. In one aspect of the invention, the cells are washed with phosphate buffered saline (PBS). In an alternative aspect, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation. A specific subpopulation of T cells, such as CD3+, CD28+, CD4+, CD8+, CD45RA+, and CD45RO+ T cells, can be further isolated by positive or negative selection techniques. For example, in one aspect, T cells are isolated by incubation with anti-CD3/anti-CD28 (e.g., 3×28)-conjugated beads, such as DYNABEADS® M-450 CD3/CD28 T, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another preferred aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used in the context of this invention. In certain aspects, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8. In certain aspects, it may be desirable to enrich for or positively select for regulatory T cells which typically express CD4+, CD25+, CD62Lhi, GITR+, and FoxP3+. Alternatively, in certain aspects, T regulatory cells are depleted by anti-C25 conjugated beads or other similar method of selection.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. In embodiments, the checkpoint inhibitor is PD1 or PD-L1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

In one embodiment, a T cell population can be selected that expresses one or more of IFN-δ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 2 billion cells/ml is used. In one aspect, a concentration of 1 billion cells/ml is used. In a further aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is 5×10e6/ml. In other aspects, the concentration used can be from about $1 \times 10^5$/ml to $1 \times 10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as immune effector cells, e.g., T cells or NK cells, isolated and frozen for later use in cell therapy, e.g., T cell therapy, for any number of diseases or conditions that would benefit from cell therapy, e.g., T cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the immune effector cells (e.g., T cells or NK cells) may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogeneic CAR

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta) or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some aspects, downregulation of HLA may be accomplished by reducing or eliminating expression of beta-2 microglobulin (B2M), In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not expresses or expresses at low levels an inhibitory molecule, e.g. a cell engineered by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR, and/or HLA, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta), in a cell, e.g., T cell.

Expression of siRNA and shRNAs in T cells can be achieved using any conventional expression system, e.g., such as a lentiviral expression system.

Exemplary shRNAs that downregulate expression of components of the TCR are described, e.g., in US Publication No.: 2012/0321667. Exemplary siRNA and shRNA that downregulate expression of HLA class I and/or HLA class II genes are described, e.g., in U.S. publication No.: US 2007/0036773.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Naturally-occurring CRISPR/Cas systems are found in approximately 40% of sequenced eubacteria genomes and 90% of sequenced archaea. Grissa et al. (2007) *BMC Bioinformatics* 8: 172. This system is a type of prokaryotic immune system that confers resistance to foreign genetic elements such as plasmids and phages and provides a form of acquired immunity. Barrangou et al. (2007) *Science* 315: 1709-1712; Marragini et al. (2008) *Science* 322: 1843-1845.

The CRISPR/Cas system has been modified for use in gene editing (silencing, enhancing or changing specific genes) in eukaryotes such as mice or primates. Wiedenheft et al. (2012) *Nature* 482: 331-8. This is accomplished by introducing into the eukaryotic cell a plasmid containing a specifically designed CRISPR and one or more appropriate Cas.

The CRISPR sequence, sometimes called a CRISPR locus, comprises alternating repeats and spacers. In a naturally-occurring CRISPR, the spacers usually comprise sequences foreign to the bacterium such as a plasmid or phage sequence; in the TCR and/or HLA CRISPR/Cas system, the spacers are derived from the TCR or HLA gene sequence.

RNA from the CRISPR locus is constitutively expressed and processed by Cas proteins into small RNAs. These comprise a spacer flanked by a repeat sequence. The RNAs guide other Cas proteins to silence exogenous genetic elements at the RNA or DNA level. Horvath et al. (2010) *Science* 327: 167-170; Makarova et al. (2006) *Biology Direct* 1: 7. The spacers thus serve as templates for RNA molecules, analogously to siRNAs. Pennisi (2013) *Science* 341: 833-836.

As these naturally occur in many different types of bacteria, the exact arrangements of the CRISPR and structure, function and number of Cas genes and their product differ somewhat from species to species. Haft et al. (2005) *PLoS Comput. Biol.* 1: e60; Kunin et al. (2007) *Genome Biol.* 8: R61; Mojica et al. (2005) *J. Mol. Evol.* 60: 174-182; Bolotin et al. (2005) *Microbiol.* 151: 2551-2561; Pourcel et al. (2005) *Microbiol.* 151: 653-663; and Stern et al. (2010) *Trends. Genet.* 28: 335-340. For example, the Cse (Cas subtype, *E. coli*) proteins (e.g., CasA) form a functional complex, Cascade, that processes CRISPR RNA transcripts into spacer-repeat units that Cascade retains. Brouns et al. (2008) *Science* 321: 960-964. In other prokaryotes, Cas6 processes the CRISPR transcript. The CRISPR-based phage inactivation in *E. coli* requires Cascade and Cas3, but not Cas1 or Cas2. The Cmr (Cas RAMP module) proteins in *Pyrococcus furiosus* and other prokaryotes form a functional complex with small CRISPR RNAs that recognizes and cleaves complementary target RNAs. A simpler CRISPR system relies on the protein Cas9, which is a nuclease with two active cutting sites, one for each strand of the double helix. Combining Cas9 and modified CRISPR locus RNA can be used in a system for gene editing. Pennisi (2013) *Science* 341: 833-836.

The CRISPR/Cas system can thus be used to edit a TCR and/or HLA gene (adding or deleting a basepair), or introducing a premature stop which thus decreases expression of a TCR and/or HLA. The CRISPR/Cas system can alternatively be used like RNA interference, turning off TCR and/or HLA gene in a reversible fashion. In a mammalian cell, for example, the RNA can guide the Cas protein to a TCR and/or HLA promoter, sterically blocking RNA polymerases.

Artificial CRISPR/Cas systems can be generated which inhibit TCR and/or HLA, using technology known in the art, e.g., that described in U.S. Publication No. 20140068797, and Cong (2013) *Science* 339: 819-823. Other artificial CRISPR/Cas systems that are known in the art may also be generated which inhibit TCR and/or HLA, e.g., that described in Tsai (2014) *Nature Biotechnol.*, 32:6 569-576, U.S. Pat. Nos. 8,871,445; 8,865,406; 8,795,965; 8,771,945; and 8,697,359.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA, and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

TALENs are produced artificially by fusing a TAL effector DNA binding domain to a DNA cleavage domain. Transcription activator-like effects (TALEs) can be engineered to bind any desired DNA sequence, including a portion of the HLA or TCR gene. By combining an engineered TALE with a DNA cleavage domain, a restriction enzyme can be produced which is specific to any desired DNA sequence, including a HLA or TCR sequence. These can then be introduced into a cell, wherein they can be used for genome editing. Boch (2011) Nature Biotech. 29: 135-6; and Boch et al. (2009) Science 326: 1509-12; Moscou et al. (2009) Science 326: 3501.

TALEs are proteins secreted by Xanthomonas bacteria. The DNA binding domain contains a repeated, highly conserved 33-34 amino acid sequence, with the exception of the 12th and 13th amino acids. These two positions are highly variable, showing a strong correlation with specific nucleotide recognition. They can thus be engineered to bind to a desired DNA sequence.

To produce a TALEN, a TALE protein is fused to a nuclease (N), which is a wild-type or mutated FokI endonuclease. Several mutations to FokI have been made for its use in TALENs; these, for example, improve cleavage specificity or activity. Cermak et al. (2011) Nucl. Acids Res. 39: e82; Miller et al. (2011) Nature Biotech. 29: 143-8; Hockemeyer et al. (2011) Nature Biotech. 29: 731-734; Wood et al. (2011) Science 333: 307; Doyon et al. (2010) Nature Methods 8: 74-79; Szczepek et al. (2007) Nature Biotech. 25: 786-793; and Guo et al. (2010) J. Mol. Biol. 200: 96.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity. Miller et al. (2011) Nature Biotech. 29: 143-8.

A HLA or TCR TALEN can be used inside a cell to produce a double-stranded break (DSB). A mutation can be introduced at the break site if the repair mechanisms improperly repair the break via non-homologous end joining. For example, improper repair may introduce a frame shift mutation. Alternatively, foreign DNA can be introduced into the cell along with the TALEN; depending on the sequences of the foreign DNA and chromosomal sequence, this process can be used to correct a defect in the HLA or TCR gene or introduce such a defect into a wt HLA or TCR gene, thus decreasing expression of HLA or TCR.

TALENs specific to sequences in HLA or TCR can be constructed using any method known in the art, including various schemes using modular components. Zhang et al. (2011) Nature Biotech. 29: 149-53; Geibler et al. (2011) PLoS ONE 6: e19509.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA, and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Like a TALEN, a ZFN comprises a FokI nuclease domain (or derivative thereof) fused to a DNA-binding domain. In the case of a ZFN, the DNA-binding domain comprises one or more zinc fingers. Carroll et al. (2011) Genetics Society of America 188: 773-782; and Kim et al. (1996) Proc. Natl. Acad. Sci. USA 93: 1156-1160.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart. Bitinaite et al. (1998) Proc. Natl. Acad. Sci. USA 95: 10570-5.

Also like a TALEN, a ZFN can create a double-stranded break in the DNA, which can create a frame-shift mutation if improperly repaired, leading to a decrease in the expression and amount of HLA and/or TCR in a cell. ZFNs can also be used with homologous recombination to mutate in the HLA or TCR gene.

ZFNs specific to sequences in HLA AND/OR TCR can be constructed using any method known in the art. See, e.g., Provasi (2011) Nature Med. 18: 807-815; Torikai (2013) Blood 122: 1341-1349; Cathomen et al. (2008) Mol. Ther. 16: 1200-7; Guo et al. (2010) J. Mol. Biol. 400: 96; U.S. Patent Publication 2011/0158957; and U.S. Patent Publication 2012/0060230.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In one aspect, the disclosure features a method of making a population of immune effector cells (e.g., T cells, NK cells). In an embodiment, the method comprises: providing a population of immune effector cells (e.g., T cells or NK cells), contacting the population of immune effector cells with a nucleic acid encoding a CAR; and contacting the population of immune effector cells with a nucleic acid encoding a telomerase subunit, e.g., hTERT, under conditions that allow for CAR and telomerase expression.

In an embodiment, the nucleic acid encoding the telomerase subunit is DNA. In an embodiment, the nucleic acid encoding the telomerase subunit comprises a promoter capable of driving expression of the telomerase subunit.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795) as follows:

```
                                              (SEQ ID NO: 284)
MPRAPRCRAVRSLLRSHYREVLPLATFVRRLGPQGWRLVQRGDPAAFRAL

VAQCLVCVPWDARPPPAAPSFRQVSCLKELVARVLQRLCERGAKNVLAFG

FALLDGARGGPPEAFTTSVRSYLPNTVTDALRGSGAWGLLLRRVGDDVLV

HLLARCALFVLVAPSCAYQVCGPPLYQLGAATQARPPPHASGPRRRLGCE

RAWNHSVREAGVPLGLPAPGARRRGGSASRSLPLPKRPRRGAAPEPERTP

VGQGSWAHPGRTRGPSDRGFCVVSPARPAEEATSLEGALSGTRHSHPSVG

RQHHAGPPSTSRPPRPWDTPCPPVYAETKHFLYSSGDKEQLRPSFLLSSL

RPSLTGARRLVETIFLGSRPWMPGTPRRLPRLPQRYWQMRPLFLELLGNH

AQCPYGVLLKTHCPLRAAVTPAAGVCAREKPQGSVAAPEEEDTDPRRLVQ

LLRQHSSPWQVYGFVRACLRRLVPPGLWGSRHNERRFLRNTKKFISLGKH

AKLSLQELTWKMSVRGCAWLRRSPGVGCVPAAEHRLREEILAKFLHWLMS

VYVVELLRSFFYVTETTFQKNRLFFYRKSVWSKLQSIGIRQHLKRVQLRE

LSEAEVRQHREARPALLTSRLRFIPKPDGLRPIVNMDYVVGARTFRREKR

AERLTSRVKALFSVLNYERARRPGLLGASVLGLDDIHRAWRTFVLRVRAQ

DPPPELYFVKVDVTGAYDTIPQDRLTEVIASIIKPQNTYCVRRYAVVQKA

AHGHVRKAFKSHVSTLTDLQPYMRQFVAHLQETSPLRDAVVIEQSSSLNE

ASSGLFDVFLRFMCHHAVRIRGKSYVQCQGIPQGSILSTLLCSLCYGDME

NKLFAGIRRDGLLLRLVDDFLLVTPHLTHAKTFLRTLVRGVPEYGCVVNL

RKTVVNFPVEDEALGGTAFVQMPAHGLFPWCGLLLDTRTLEVQSDYSSYA

RTSIRASLTFNRGFKAGRNMRRKLFGVLRLKCHSLFLDLQVNSLQTVCTN

IYKILLLQAYRFHACVLQLPFHQQVWKNPTFFLRVISDTASLCYSILKAK

NAGMSLGAKGAAGPLPSEAVQWLCHQAFLLKLTRHRVTYVPLLGSLRTAQ

TQLSRKLPGTTLTALEAAANPALPSDFKTILD
```

In an embodiment, the hTERT has a sequence at least 80%, 85%, 90%, 95%, 96^, 97%, 98%, or 99% identical to the sequence of SEQ ID NO: 284. In an embodiment, the hTERT has a sequence of SEQ ID NO: 284. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

```
                                                       (SEQ ID NO: 285)
   1 caggcagcgt ggtcctgctg cgcacgtggg aagccctggc cccggccacc cccgcgatgc 61 cgcgcgctcc ccgctgccga gccgtgcgct ccctgctgcg cagccactac cgcgaggtgc 121 tgccgctggc cacgttcgtg cggcgcctgg ggccccaggg ctggcggctg gtgcagcgcg 181 gggacccggc ggctttccgc gcgctggtgg cccagtgcct ggtgtgcgtg ccctgggacg 241 cacggccgcc ccccgccgcc ccctccttcc gccaggtgtc ctgcctgaag gagctggtgg 301 cccgagtgct gcagaggctg tgcgagcgcg gcgcgaagaa cgtgctggcc ttcggcttcg 361 cgctgctgga cggggcccgc gggggccccc ccgaggcctt caccaccagc gtgcgcagct 421 acctgcccaa cacggtgacc gacgcactgc ggggagcgg ggcgtggggg ctgctgttgc 481 gccgcgtggg cgacgacgtg ctggttcacc tgctggcacg ctgcgcgctc tttgtgctgg 541 tggctcccag ctgcgcctac caggtgtgcg ggccgccgct gtaccagctc ggcgctgcca 601 ctcaggcccg gccccgcca cacgctagtg acccccgaag gcgtctggga tgcgaacggg 661 cctggaacca tagcgtcagg gaggccgggg tccccctggg cctgccagcc ccgggtgcga 721 ggaggcgcgg gggcagtgcc agccgaagtc tgccgttgcc caagaggccc aggcgtggcg 781 ctgcccctga gccggagcgg acgcccgttg ggcagggtc ctgggcccac ccgggcagga 841 cgcgtggacc gagtgaccgt ggtttctgtg tggtgtcacc tgccagaccc gccgaagaag 901 ccacctcttt ggagggtgcg ctctctggca cgcgccactc ccacccatcc gtgggccgcc 961 agcaccacgc gggcccccca tccacatcgc ggccaccacg tccctgggac acgccttgtc 1021 ccccggtgta cgccgagacc aagcacttcc tctactcctc aggcgacaag gagcagctgc 1081 ggcctccttcctactcagc tctctgaggc ccagcctgac tggcgctcgg aggctcgtgg 1141 agaccatctt tctgggttcc aggccctgga tgccagggac tccccgcagg ttgccccgcc 1201 tgccccagcg ctactggcaa atgcggcccc tgtttctgga gctgcttggg aaccacgcgc
```

-continued

```
1261 agtgcccta cggggtgctc ctcaagacgc actgcccgct gcgagctgcg gtcaccccag
1321 cagccggtgt ctgtgcccgg gagaagcccc agggctctgt ggcggccccc gaggaggagg
1381 acacagaccc ccgtcgcctg gtgcagctgc tccgccagca cagcagcccc tggcaggtgt
1441 acggcttcgt gcgggcctgc ctgcgccggc tggtgccccc aggcctctgg ggctccaggc
1501 acaacgaacg ccgcttcctc aggaacacca agaagttcat ctccctgggg aagcatgcca
1561 agctctcgct gcaggagctg acgtggaaga tgagcgtgcg gggctgcgct tggctgcgca
1621 ggagcccagg ggttggctgt gttccggccg cagagcaccg tctgcgtgag gagatcctgg
1681 ccaagttcct gcactggctg atgagtgtgt acgtcgtcga gctgctcagg tctttctttt
1741 atgtcacgga gaccacgttt caaaagaaca ggctcttttt ctaccggaag agtgtctgga
1801 gcaagttgca aagcattgga atcagacagc acttgaagag ggtgcagctg cgggagctgt
1861 cggaagcaga ggtcaggcag catcgggaag ccaggcccgc cctgctgacg tccagactcc
1921 gcttcatccc caagcctgac gggctgcggc cgattgtgaa catggactac gtcgtgggag
1981 ccagaacgtt ccgcagagaa agagggccg agcgtctcac ctcgagggtg aaggcactgt
2041 tcagcgtgct caactacgag cgggcgcggc gccccggcct cctgggcgcc tctgtgctgg
2101 gcctggacga tatccacagg gcctggcgca ccttcgtgct gcgtgtgcgg gcccaggacc
2161 cgccgcctga gctgtacttt gtcaaggtgg atgtgacggg cgcgtacgac accatccccc
2221 aggacaggct cacggaggtc atcgccagca tcatcaaacc ccagaacacg tactgcgtgc
2281 gtcggtatgc cgtggtccag aaggccgccc atgggcacgt ccgcaaggcc ttcaagagcc
2341 acgtctctac cttgacagac ctccagccgt acatgcgaca gttcgtggct cacctgcagg
2401 agaccagccc gctgagggat gccgtcgtca tcgagcagag ctcctccctg aatgaggcca
2461 gcagtggcct cttcgacgtc ttcctacgct tcatgtgcca ccacgccgtg cgcatcaggg
2521 gcaagtccta cgtccagtgc caggggatcc cgcagggctc catcctctcc acgctgctct
2581 gcagcctgtg ctacggcgac atggagaaca agctgtttgc ggggattcgg cgggacgggc
2641 tgctcctgcg tttggtggat gatttcttgt tggtgacacc tcacctcacc cacgcgaaaa
2701 ccttcctcag gaccctggtc cgaggtgtcc ctgagtatgg ctgcgtggtg aacttgcgga
2761 agacagtggt gaacttccct gtagaagacg aggccctggg tggcacggct tttgttcaga
2821 tgccggccca cggcctattc ccctggtgcg gcctgctgct ggatacccgg accctggagg
2881 tgcagagcga ctactccagc tatgcccgga cctccatcag agccagtctc accttcaacc
2941 gcggcttcaa ggctgggagg aacatgcgtc gcaaactctt tggggtcttg cggctgaagt
3001 gtcacagcct gtttctggat ttgcaggtga acagcctcca gacggtgtgc accaacatct
3061 acaagatcct cctgctgcag gcgtacaggt ttcacgcatg tgtgctgcag ctcccatttc
3121 atcagcaagt ttggaagaac cccacatttt tcctgcgcgt catctctgac acggcctccc
3181 tctgctactc catcctgaaa gccaagaacg cagggatgtc gctgggggcc aagggcgccg
3241 ccggccctct gccctccgag gccgtgcagt ggctgtgcca ccaagcattc ctgctcaagc
3301 tgactcgaca ccgtgtcacc tacgtgccac tcctggggtc actcaggaca gcccagacgc
3361 agctgagtcg gaagctcccg gggacgacgc tgactgccct ggaggccgca gccaacccgg
3421 cactgcccct cagacttcaag accatcctgg actgatggcc accgcccac agccaggccg
3481 agagcagaca ccagcagccc tgtcacgccg ggctctacgt cccagggagg gaggggcggc
3541 ccacacccag gcccgcaccg ctgggagtct gaggcctgag tgagtgtttg gccgaggcct
3601 gcatgtccgg ctgaaggctg agtgtccggc tgaggcctga gcgagtgtcc agccaagggc
```

```
-continued
3661 tgagtgtcca gcacacctgc cgtcttcact tccccacagg ctggcgctcg gctccacccc 3721 agggccagct tttcctcacc aggagcccgg cttccactcc ccacatagga atagtccatc 3781 cccagattcg ccattgttca cccctcgccc tgccctcctt tgccttccac ccccaccatc 3841 caggtggaga ccctgagaag gaccctggga gctctgggaa tttggagtga ccaaaggtgt 3901 gccctgtaca caggcgagga ccctgcacct ggatgggggt ccctgtgggt caaattgggg 3961 ggaggtgctg tgggagtaaa atactgaata tatgagtttt tcagttttga aaaaaaaaa 4021 aaaaaaa
```

In an embodiment, the hTERT is encoded by a nucleic acid having a sequence at least 80%, 85%, 90%, 95%, 96, 97%, 98%, or 99% identical to the sequence of SEQ ID NO: 285. In an embodiment, the hTERT is encoded by a nucleic acid of SEQ ID NO: 285.

Activation and Expansion of T Cells

T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

Generally, the T cells of the invention may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect of the present invention, more anti-CD28 antibody is bound to the particles than anti-CD3 antibody, i.e., the ratio of CD3:CD28 is less than one. In certain aspects of the invention, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects of the present invention, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a BCMA CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a BCMA CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a BCMA CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a BCMA CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one aspect of the present invention, the mixture may be cultured for several hours (about 3 hours) to about 14 days or any hourly integer value in between. In one aspect, the mixture may be cultured for 21 days. In one aspect of the invention the beads and the T cells are cultured together for about eight days. In one aspect, the beads and T cells are cultured together for 2-3 days. Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, e.g., CAR-expressing cell manufacturing methods, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments a CAR-expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a BCMA CAR is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a BCMA CAR are described in further detail below Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of $CAR^+$ T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the $CD4^+$ and/or $CD8^+$ T cell subsets by flow cytometry. See, e.g., Milone et al., Molecular Therapy 17(8): 1453-1464 (2009). Alternatively, a mixture of $CD4^+$ and $CD8^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with BCMA-expressing cells, such as multiple myeloma cell lines or K562-BCMA, following washing. Exogenous IL-2 is added to the cultures every other day at 100 IU/ml. $GFP^+$ T cells are enumerated by flow cytometry using bead-based counting. See, e.g., Milone et al., Molecular Therapy 17(8): 1453-1464 (2009).

Sustained $CAR^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human BCMA-specific $CAR^+$ T cells to treat a primary human multiple myeloma in immunodeficient mice can be used. See, e.g., Milone et al., Molecular Therapy 17(8): 1453-1464 (2009). Very briefly, after establishment of MM, mice are randomized as to treatment groups. Different numbers of BCMA CART cells can be injected into immunodeficient mice bearing MM. Animals are assessed for disease progression and tumor burden at weekly intervals. Survival curves for the groups are compared using the log-rank test. In addition, absolute peripheral blood $CD4^+$ and $CD8^+$ T cell counts 4 weeks following T cell injection in the immunodeficient mice can also be analyzed. Mice are injected with multiple myeloma cells and 3 weeks later are injected with T cells engineered to express BCMA CAR, e.g., by a bicistronic lentiviral vector that encodes the CAR linked to eGFP. T cells are normalized to 45-50% input GFP$^+$ T cells by mixing with mock-transduced cells prior to injection, and confirmed by flow cytometry. Animals are assessed for leukemia at 1-week intervals. Survival curves for the CAR$^+$ T cell groups are compared using the log-rank test.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing BCMA or other BCMA-expressing myeloma cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8$^+$ T cell expansion ex vivo. T cells are enumerated in cultures using Count-Bright™ fluorescent beads (Invitrogen, Carlsbad, Calif.) and flow cytometry as described by the manufacturer. CAR$^+$ T cells are identified by GFP expression using T cells that are engineered with eGFP-2A linked CAR-expressing lentiviral vectors. For CAR+ T cells not expressing GFP, the CAR+ T cells are detected with biotinylated recombinant BCMA protein and a secondary avidin-PE conjugate. CD4+ and CD8$^+$ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, Calif.) according the manufacturer's instructions. Fluorescence is assessed using a FACScalibur flow cytometer, and data is analyzed according to the manufacturer's instructions.

Cytotoxicity can be assessed by a standard 51Cr-release assay. See, e.g., Milone et al., Molecular Therapy 17(8): 1453-1464 (2009). Briefly, target cells (e.g., K562 lines expressing BCMA and primary multiple myeloma cells) are loaded with 51Cr (as NaCrO4, New England Nuclear, Boston, Mass.) at 37° C. for 2 hours with frequent agitation, washed twice in complete RPMI and plated into microtiter plates. Effector T cells are mixed with target cells in the wells in complete RPMI at varying ratios of effector cell: target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, Mass.). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/γc$^{-/-}$ (NSG) mice or other immunodeficient are injected IV with multiple myeloma cells followed 7 days later with BCMA CART cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR$^+$ T cells in a multiple myeloma xenograft model can be measured as the following: NSG mice are injected with multiple myeloma cells transduced to stably express firefly luciferase, followed by a single tail-vein injection of T cells electroporated with BCMA CAR construct days later. Animals are imaged at various time points post injection. For example, photon-density heat maps of firefly luciferasepositive tumors in representative mice at day 5 (2 days before treatment) and day 8 (24 hr post CAR$^+$ PBLs) can be generated.

Alternatively, or in combination to the methods disclosed herein, methods and compositions for one or more of: detection and/or quantification of CAR-expressing cells (e.g., in vitro or in vivo (e.g., clinical monitoring)); immune cell expansion and/or activation; and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain). In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

providing the CAR ligand (optionally, a labelled CAR ligand, e.g., a CAR ligand that includes a tag, a bead, a radioactive or fluorescent label);

acquiring the CAR-expressing cell (e.g., acquiring a sample containing CAR-expressing cells, such as a manufacturing sample or a clinical sample);

contacting the CAR-expressing cell with the CAR ligand under conditions where binding occurs, thereby detecting the level (e.g., amount) of the CAR-expressing cells present. Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

providing a CAR-expressing cell (e.g., a first CAR-expressing cell or a transiently expressing CAR cell);

contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In yet another aspect, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting, reducing and/or killing a CAR expressing cell is provided. The method includes contacting the CAR expressing cell with a CAR ligand as described herein; and targeting the cell on the basis of binding of the CAR ligand, thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference. In one embodiment, the anti-idiotypic antibody molecule recognizes an anti-CD19 antibody molecule, e.g., an anti-CD19 scFv. For instance, the anti-idiotypic antibody molecule can compete for binding with the CD19-specific CAR mAb clone no. 136.20.1 described in Jena et al., PLOS March 2013 8:3 e57838; may have the same CDRs (e.g., one or more of, e.g., all of, VH CDR1, VH CDR2, CH CDR3, VL CDR1, VL CDR2, and VL CDR3, using the Kabat definition, the Chothia definition, or a combination of the Kabat and Chothia definitions) as the CD19-specific CAR mAb clone no. 136.20.1; may have one or more (e.g., 2) variable regions as the CD19-specific CAR mAb clone no. 136.20.1, or may comprise the CD19-specific CAR mAb clone no. 136.20.1. In some embodiments, the anti-idiotypic antibody was made according to a method described in Jena et al. In another embodiment, the anti-idiotypic antibody molecule is an anti-idiotypic antibody molecule described in WO 2014/190273. In some embodiments, the anti-idiotypic antibody molecule has the same CDRs (e.g., one or more of, e.g., all of, VH CDR1, VH CDR2, CH CDR3, VL CDR1, VL CDR2, and VL CDR3) as an antibody molecule of WO 2014/190273 such as 136.20.1; may have one or more (e.g., 2) variable regions of an antibody molecule of WO 2014/190273, or may comprise an antibody molecule of WO 2014/190273 such as 136.20.1. In other embodiments, the anti-CAR antibody binds to a constant region of the extracellular binding domain of the CAR molecule, e.g., as described in WO 2014/190273. In some embodiments, the anti-CAR antibody binds to a constant region of the extracellular binding domain of the CAR molecule, e.g., a heavy chain constant region (e.g., a CH2-CH3 hinge region) or light chain constant region. For instance, in some embodiments the anti-CAR antibody competes for binding with the 2D3 monoclonal antibody described in WO 2014/190273, has the same CDRs (e.g., one or more of, e.g., all of, VH CDR1, VH CDR2, CH CDR3, VL CDR1, VL CDR2, and VL CDR3) as 2D3, or has one or more (e.g., 2) variable regions of 2D3, or comprises 2D3 as described in WO 2014/190273.

In some aspects and embodiments, the compositions and methods herein are optimized for a specific subset of T cells, e.g., as described in U.S. Ser. No. 62/031,699 filed Jul. 31, 2014, the contents of which are incorporated herein by reference in their entirety. In some embodiments, the optimized subsets of T cells display an enhanced persistence compared to a control T cell, e.g., a T cell of a different type (e.g., $CD8^+$ or $CD4^+$) expressing the same construct.

In some embodiments, a $CD4^+$ T cell comprises a CAR described herein, which CAR comprises an intracellular signaling domain suitable for (e.g., optimized for, e.g., leading to enhanced persistence in) a $CD4^+$ T cell, e.g., an ICOS domain. In some embodiments, a $CD8^+$ T cell comprises a CAR described herein, which CAR comprises an intracellular signaling domain suitable for (e.g., optimized for, e.g., leading to enhanced persistence of) a $CD8^+$ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain that targets BCMA, e.g., a CAR of Tables 8 or 10).

In an aspect, described herein is a method of treating a subject, e.g., a subject having cancer. The method includes administering to said subject, an effective amount of:

1) a $CD4^+$ T cell comprising a CAR (the $CAR^{CD4+}$) comprising:
an antigen binding domain, e.g., an antigen binding domain described herein, e.g., an antigen binding domain that targets BCMA, e.g., an antigen-binding domain of Tables 8 or 10;
a transmembrane domain; and
an intracellular signaling domain, e.g., a first costimulatory domain, e.g., an ICOS domain; and
2) a $CD8^+$ T cell comprising a CAR (the $CAR^{CD8+}$) comprising:
an antigen binding domain, e.g., an antigen binding domain described herein, e.g., an antigen binding domain that targets BCMA, e.g., an antigen-binding domain of Tables 8 or 10;
a transmembrane domain; and
an intracellular signaling domain, e.g., a second co stimulatory domain, e.g., a 4-1BB domain, a CD28 domain, or another costimulatory domain other than an ICOS domain;
wherein the $CAR^{CD4+}$ and the $CAR^{CD8+}$ differ from one another.

Optionally, the method further includes administering:
3) a second CD8+ T cell comprising a CAR (the second $CAR^{CD8+}$) comprising:
an antigen binding domain, e.g., an antigen binding domain described herein, e.g., an antigen binding domain that specifically binds BCMA, e.g., an antigen-binding domain of Tables 8 or 10;
a transmembrane domain; and
an intracellular signaling domain, wherein the second $CAR^{CD8+}$ comprises an intracellular signaling domain, e.g., a costimulatory signaling domain, not present on the $CAR^{CD8+}$, and, optionally, does not comprise an ICOS signaling domain.

Other assays, including those described in the Example section herein as well as those that are known in the art can also be used to evaluate the BCMA CAR constructs of the invention.

Therapeutic Application

BCMA Associated Diseases and/or Disorders

In one aspect, the invention provides methods for treating a disease associated with BCMA expression. In one aspect, the invention provides methods for treating a disease wherein part of the tumor is negative for BCMA and part of the tumor is positive for BCMA For example, the CAR of the invention is useful for treating subjects that have undergone treatment for a disease associated with elevated expression of BCMA, wherein the subject that has undergone treatment for elevated levels of BCMA exhibits a disease associated with elevated levels of BCMA. In embodiments, the CAR of the invention is useful for treating subjects that have undergone treatment for a disease associated with expression of BCMA, wherein the subject that has undergone treatment related to expression of BCMA exhibits a disease associated with expression of BCMA.

In one embodiment, the invention provides methods for treating a disease wherein BCMA is expressed on both normal cells and cancers cells, but is expressed at lower levels on normal cells. In one embodiment, the method further comprises selecting a CAR that binds of the invention with an affinity that allows the BCMA CAR to bind and kill the cancer cells expressing BCMA but less than 30%, 25%, 20%, 15%, 10%, 5% or less of the normal cells expressing BCMA are killed, e.g., as determined by an assay described herein. For example, a killing assay such as flow cytometry based on Cr51 CTL can be used. In one embodiment, the BCMA CAR has an antigen binding domain that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the BCMA antigen binding domain has a binding affinity that is at least five-fold, 10-fold, 20-fold, 30-fold, 50-fold, 100-fold or 1,000-fold less than a reference antibody, e.g., an antibody described herein.

In one aspect, the invention pertains to a vector comprising BCMA CAR operably linked to promoter for expression in mammalian immune effector cells, e.g., T cells or NK cells. In one aspect, the invention provides a recombinant immune effector cell, e.g., T cell or NK cell, expressing the BCMA CAR for use in treating BCMA-expressing tumors, wherein the recombinant immune effector cell (e.g., T cell or NK cell) expressing the BCMA CAR is termed a BCMA CAR-expressing cell (e.g., BCMA CART or BCMA CAR-expressing NK cell). In one aspect, the BCMA CAR-expressing cell (e.g., BCMA CART or BCMA CAR-expressing NK cell) of the invention is capable of contacting a tumor cell with at least one BCMA CAR of the invention expressed on its surface such that the BCMA CAR-expressing cell (e.g., BCMA CART or BCMA CAR-expressing NK cell) targets the tumor cell and growth of the tumor is inhibited.

In one aspect, the invention pertains to a method of inhibiting growth of a BCMA-expressing tumor cell, comprising contacting the tumor cell with a BCMA CAR-expressing cell (e.g., BCMA CART or BCMA CAR-expressing NK cell) of the present invention such that the BCMA CAR-expressing cell (e.g., BCMA CART or BCMA CAR-expressing NK cell) is activated in response to the antigen and targets the cancer cell, wherein the growth of the tumor is inhibited.

In one aspect, the invention pertains to a method of treating cancer in a subject. The method comprises administering to the subject a BCMA CAR-expressing cell (e.g., BCMA CART or BCMA CAR-expressing NK cell) of the present invention such that the cancer is treated in the subject. An example of a cancer that is treatable by the BCMA CAR-expressing cell (e.g., BCMA CART or BCMA CAR-expressing NK cell) of the invention is a cancer associated with expression of BCMA.

The invention includes a type of cellular therapy where immune effector cells (e.g., T cells or NK cells) are genetically modified to express a chimeric antigen receptor (CAR) and the BCMA CAR-expressing cell (e.g., BCMA CART or BCMA CAR-expressing NK cell) is infused to a recipient in need thereof. The infused cell is able to kill tumor cells in the recipient. Unlike antibody therapies, CAR-modified cells, e.g., T cells or NK cells, are able to replicate in vivo resulting in long-term persistence that can lead to sustained tumor control. In various aspects, the cells (e.g., T cells or NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the cell (e.g., T cell or NK cell) to the patient.

The invention also includes a type of cellular therapy where immune effector cells (e.g., T cells or NK cells) are modified, e.g., by in vitro transcribed RNA, to transiently express a chimeric antigen receptor (CAR) and the immune effector cell (e.g., T cell or NK cell) is infused to a recipient in need thereof. The infused cell is able to kill tumor cells in the recipient. Thus, in various aspects, the immune effector cells (e.g., T cells or NK cells) administered to the patient, is present for less than one month, e.g., three weeks, two weeks, one week, after administration of the immune effector cell (e.g., T cell or NK cell) to the patient.

Without wishing to be bound by any particular theory, the anti-tumor immunity response elicited by the CAR-modified immune effector cells (e.g., T cells or NK cells) may be an active or a passive immune response, or alternatively may be due to a direct vs indirect immune response. In one aspect, the CAR transduced immune effector cells (e.g., T cells or NK cells) exhibit specific proinflammatory cytokine secretion and potent cytolytic activity in response to human cancer cells expressing the BCMA, resist soluble BCMA inhibition, mediate bystander killing and mediate regression of an established human tumor. For example, antigen-less tumor cells within a heterogeneous field of BCMA-expressing tumor may be susceptible to indirect destruction by BCMA-redirected immune effector cells (e.g., T cells or NK cells) that has previously reacted against adjacent antigen-positive cancer cells.

In one aspect, the fully-human CAR-modified immune effector cells (e.g., T cells or NK cells) of the invention may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified immune effector cells (e.g., T cells or NK cells) of the invention are used in the treatment of diseases, disorders and conditions associated with expression of BCMA. In certain aspects, the cells of the invention are used in the treatment of patients at risk for developing diseases, disorders and conditions associated with expression of BCMA. Thus, the present invention provides methods for the treatment or prevention of diseases, disorders and conditions associated with expression of BCMA comprising administering to a subject in need thereof, a therapeutically effective amount of the CAR-modified immune effector cells (e.g., T cells or NK cells) of the invention.

In one aspect the CAR-expressing cells (e.g., CART cells or CAR-expressing NK cells) of the inventions may be used to treat a proliferative disease such as a cancer or malignancy or is a precancerous condition such as a myelodysplasia, a myelodysplastic syndrome or a preleukemia. In one aspect, the cancer is a hematolical cancer. Hematological cancer conditions are the types of cancer such as leukemia and malignant lymphoproliferative conditions that affect blood, bone marrow and the lymphatic system. In one aspect, the hematological cancer is a leukemia or a hematological. An example of a disease or disorder associated with BCMA is multiple myeloma (also known as MM) (See Claudio et al., *Blood.* 2002, 100(6):2175-86; and Novak et al., *Blood.* 2004, 103(2):689-94). Multiple myeloma, also known as plasma cell myeloma or Kahler's disease, is a cancer characterized by an accumulation of abnormal or malignant plasma B-cells in the bone marrow. Frequently, the cancer cells invade adjacent bone, destroying skeletal structures and resulting in bone pain and fractures. Most cases of myeloma also features the production of a paraprotein (also known as M proteins or myeloma proteins), which is an abnormal immunoglobulin produced in excess by the clonal proliferation of the malignant plasma cells. Blood serum paraprotein levels of more than 30 g/L is diagnostic of multiple myeloma, according to the diagnostic criteria of the International Myeloma Working Group (IMWG) (See Kyle et al. (2009), Leukemia. 23:3-9). Other symptoms or signs of multiple myeloma include reduced kidney function or renal failure, bone lesions, anemia, hypercalcemia, and neurological symptoms.

Criteria for distinguishing multiple myeloma from other plasma cell proliferative disorders have been established by the International Myeloma Working Group (See Kyle et al. (2009), Leukemia. 23:3-9). All three of the following criteria must be met:
Clonal bone marrow plasma cells ≥10%
Present of serum and/or urinary monoclonal protein (except in patients with true non-secretory multiple myeloma)
Evidence of end-organ damage attributable to the underlying plasma cell proliferative disorder, specifically:
Hypercalcemia: serum calcium ≥11.5 mg/100 ml
Renal insufficienty: serum creatinine >1.73 mmol/l
Anemia: normochromic, normocytic with a hemoglobin value of >2 g/100 ml below the lower limit of normal, or a hemoglobin value <10 g/100 ml
Bone lesions: lytic lesions, severe osteopenia, or pathologic fractures.

Other plasma cell proliferative disorders that can be treated by the compositions and methods described herein include, but are not limited to, asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

Two staging systems are used in the staging of multiple myeloma: the International Staging System (ISS) (See Greipp et al. (2005), J. Clin. Oncol. 23 (15):3412-3420) and the Durie-Salmon Staging system (DSS) (See Durie et al. (1975), Cancer 36 (3): 842-854). The two staging systems are summarized in the table below:

TABLE 12

| | International Staging System | | Durie-Salmon Staging System | |
|---|---|---|---|---|
| Stage | Criteria | Median survival | Criteria | Median survival* |
| I | $\beta_2M$ <3.5 mg/l and serum albumin ≥3.5 g/dL | 62 months | All of the following: Hemoglobin level >10 g/dL Serum calcium, normal or <12 mg/dL Bone x-ray, normal or 1 plasmacytoma only Low monoclonal protein production (IgG <5 g/dL, IgA <3 g/dL, Bence Jones protein <4 g/dL per 24 hours | IA: 62 months IB: 22 months |
| II | Neither stage I or stage III | 44 months | Neither stage I or stage III | IIA: 58 months IIB: 354 months |
| III | $\beta_2M$ ≥5.5 mg/l | 29 months | One or more of the following: Hemogloblin level <8.5 g/dL Serum calcium, normal or >12 mg/dL Advanced osteolytic lesions | IIIA: 45 months IIIB: 24 months |

TABLE 12-continued

| | International Staging System | | Durie-Salmon Staging System | |
|---|---|---|---|---|
| Stage | Criteria | Median survival | Criteria | Median survival* |
| | | | High monoclonal protein production (IgG >7 g/dL, IgA >5 g/dL, Bence Jones protein >12 g/dL per 24 hours) | |

*The Durie-Salmon Staging system also includes a subclassification that designates the status of renal function. The designation of "A" or "B" is added after the stage number, wherein "A" indicates relatively normal renal function (serum creatinine value <2.0 mg/dL), and B indicates abnormal renal function (serum creatinine value >2.0 mg/dL).

Standard treatment for multiple myeloma and associated diseases includes chemotherapy, stem cell transplant (autologous or allogeneic), radiation therapy, and other drug therapies. Frequently used anti-myeloma drugs include alkylating agents (e.g., bendamustine, cyclophosphamide and melphalan), proteasome inhibitors (e.g., bortezomib), corticosteroids (e.g., dexamethasone and prednisone), and immunomodulators (e.g., thalidomide and lenalidomide or Revlimid®), or any combination thereof. Biphosphonate drugs are also frequently administered in combination with the standard anti-MM treamtents to prevent bone loss. Patients older than 65-70 years of age are unlikely candidates for stem cell transplant. In some cases, double-autologous stem cell transplants are options for patients less than 60 years of age with suboptimal response to the first transplant. The compositions and methods of the present invention may be administered in combination with any of the currently prescribed treatments for multiple myeloma.

Another example of a disease or disorder associated with BCMA is Hodgkin's lymphoma and non-Hodgkin's lymphoma (See Chiu et al., Blood. 2007, 109(2):729-39; He et al., *J Immunol.* 2004, 172(5):3268-79).

Hodgkin's lymphoma (HL), also known as Hodgkin's disease, is a cancer of the lymphatic system that originates from white blood cells, or lymphocytes. The abnormal cells that comprise the lymphoma are called Reed-Sternberg cells. In Hodgkin's lymphoma, the cancer spreads from one lymph node group to another. Hodgkin's lymphoma can be subclassified into four pathologic subtypes based upon Reed-Sternberg cell morphology and the cell composition around the Reed-Sternberg cells (as determined through lymph node biopsy): nodular sclerosing HL, mixed-cellularity subtype, lymphocyte-rich or lymphocytic predominance, lymphocyte depleted. Some Hodgkin's lymphoma can also be nodular lymphocyte predominant Hodgkin's lymphoma, or can be unspecified. Symptoms and signs of Hodgkin's lymphoma include painless swelling in the lymph nodes in the neck, armpits, or groin, fever, night sweats, weight loss, fatigue, itching, or abdominal pain.

Non-Hodgkin's lymphoma (NHL) comprises a diverse group of blood cancers that include any kind of lymphoma other than Hodgkin's lymphoma. Subtypes of non-Hodgkin's lymphoma are classified primarily by cell morphology, chromosomal aberrations, and surface markers. NHL subtypes (or NHL-associated cancers) include B cell lymphomas such as, but not limited to, Burkitt's lymphoma, B-cell chronic lymphocytic leukemia (B-CLL), B-cell prolymphocytic leukemia (B-PLL), chronic lymphocytic leukemia (CLL), diffuse large B-cell lymphoma (DLBCL) (e.g., intravascular large B-cell lymphoma and primary mediastinal B-cell lymphoma), follicular lymphoma (e.g., follicle center lymphoma, follicular small cleaved cell), hair cell leukemia, high grade B-cell lymphoma (Burkitt's like), lymphoplasmacytic lymphoma (Waldenstrom's macroglublinemia), mantle cell lymphoma, marginal zone B-cell lymphomas (e.g., extranodal marginal zone B-cell lymphoma or mucosa-associated lymphoid tissue (MALT) lymphoma, nodal marginal zone B-cell lymphoma, and splenic marginal zone B-cell lymphoma), plasmacytoma/myeloma, precursor B-lymphoblastic leukemia/lymphoma (PB-LBL/L), primary central nervous system (CNS) lymphoma, primary intraocular lymphoma, small lymphocytic lymphoma (SLL); and T cell lymphomas, such as, but not limited to, anaplastic large cell lymphoma (ALCL), adult T-cell lymphoma/leukemia (e.g., smoldering, chronic, acute and lymphomatous), angiocentric lymphoma, angioimmunoblastic T-cell lymphoma, cutaneous T-cell lymphomas (e.g., mycosis fungoides, Sezary syndrome, etc.), extranodal natural killer/T-cell lymphoma (nasal-type), enteropathy type intestinal T-cell lymphoma, large granular lymphocyte leukemia, precursor T-lymphoblastic lymphoma/leukemia (T-LBL/L), T-cell chronic lymphocytic leukemia/prolymphocytic leukemia (T-CLL/PLL), and unspecified peripheral T-cell lymphoma. Symptoms and signs of Hodgkin's lymphoma include painless swelling in the lymph nodes in the neck, armpits, or groin, fever, night sweats, weight loss, fatigue, itching, abdominal pain, coughing, or chest pain.

The staging is the same for both Hodgkin's and non-Hodgkin's lymphoma, and refers to the extent of spread of the cancer cells within the body. In stage I, the lymphoma cells are in one lymph node group. In stage II, lymphoma cells are present in at least two lymph node groups, but both groups are on the same side of the diaphragm, or in one part of a tissue or organ and the lymph nodes near that organ on the same side of the diaphragm. In stage III, lymphoma cells are in lymph nodes on both sides of the diaphragm, or in one part of a tissue or organ near these lymph node groups or in the spleen. In stage IV, lymphoma cells are found in several parts of at least one organ or tissue, or lymphoma cells are in an organ and in lymph nodes on the other side of the diaphragm. In addition to the Roman numeral staging designation, the stages of can also be described by letters A, B, E, and S, wherein A refers to patients without symptoms, B refers to patients with symptoms, E refers to patients in which lymphoma is found in tissues outside the lymph system, and S refers to patients in which lymphoma is found in the spleen.

Hodgkin's lymphoma is commonly treated with radiation therapy, chemotherapy, or hematopoietic stem cell transplantation. The most common therapy for non-Hodgkin's lymphoma is R-CHOP, which consists of four different chemotherapies (cyclophosphamide, doxorubicin, vincristine, and prenisolone) and rituximab (Rituxan®). Other therapies commonly used to treat NHL include other chemotherapeutic agents, radiation therapy, stem cell transplantation (autologous or allogeneic bone marrow transplantation), or biological therapy, such as immunotherapy. Other examples of biological therapeutic agents include, but are not limited to, rituximab (Rituxan®), tositumomab (Bexxar®), epratuzumab (LymphoCide®), and alemtuzumab (MabCampath®). The compositions and methods of the present invention may be administered in combination with any of the currently prescribed treatments for Hodgkin's lymphoma or non-Hodgkin's lymphoma.

BCMA expression has also been associated Waldenstrom's macroglobulinemia (WM), also known as lymphoplasmacytic lymphoma (LPL). (See Elsawa et al., *Blood.*

2006, 107(7):2882-8). Waldenstrom's macroglobulinemia was previously considered to be related to multiple myeloma, but has more recently been classified as a subtype of non-Hodgkin's lymphoma. WM is characterized by uncontrolled B-cell lymphocyte proliferation, resulting in anemia and production of excess amounts of paraprotein, or immunoglobulin M (IgM), which thickens the blood and results in hyperviscosity syndrome. Other symptoms or signs of WM include fever, night sweats, fatigue, anemia, weight loss, lymphadenopathy or splenomegaly, blurred vision, dizziness, nose bleeds, bleeding gums, unusual bruises, renal impairment or failure, amyloidosis, or peripheral neuropathy.

Standard treatment for WM consists of chemotherapy, specifically with rituximab (Rituxan®). Other chemotherapeutic drugs can be used in combination, such as chlorambucil (Leukeran®), cyclophosphamide (Neosar®), fludarabine (Fludara®), cladribine (Leustatin®), vincristine, and/or thalidomide. Corticosteroids, such as prednisone, can also be administered in combination with the chemotherapy. Plasmapheresis, or plasma exchange, is commonly used throughout treatment of the patient to alleviate some symptoms by removing the paraprotein from the blood. In some cases, stem cell transplantation is an option for some patients.

Another example of a disease or disorder associated with BCMA is brain cancer. Specifically, expression of BCMA has been associated with astrocytoma or glioblastoma (See Deshayes et al, *Oncogene*. 2004, 23(17):3005-12, Pelekanou et al., *PLoS One*. 2013, 8(12):e83250). Astrocytomas are tumors that arise from astrocytes, which are a type of glial cell in the brain. Glioblastoma (also known as glioblastoma multiforme or GBM) is the most malignant form of astrocytoma, and is considered the most advanced stage of brain cancer (stage IV). There are two variants of glioblastoma: giant cell glioblastoma and gliosarcoma. Other astrocytomas include juvenile pilocytic astrocytoma (JPA), fibrillary astrocytoma, pleomorphic xantroastrocytoma (PXA), desembryoplastic neuroepithelial tumor (DNET), and anaplastic astrocytoma (AA).

Symptoms or signs associated with glioblastoma or astrocytoma include increased pressure in the brain, headaches, seizures, memory loss, changes in behavior, loss in movement or sensation on one side of the body, language dysfunction, cognitive impairments, visual impairment, nausea, vomiting, and weakness in the arms or legs.

Surgical removal of the tumor (or resection) is the standard treatment for removal of as much of the glioma as possible without damaging or with minimal damage to the normal, surrounding brain. Radiation therapy and/or chemotherapy are often used after surgery to suppress and slow recurrent disease from any remaining cancer cells or satellite lesions. Radiation therapy includes whole brain radiotherapy (conventional external beam radiation), targeted three-dimensional conformal radiotherapy, and targeted radionuclides. Chemotherapeutic agents commonly used to treat glioblastoma include temozolomide, gefitinib or erlotinib, and cisplatin. Angiogenesis inhibitors, such as Bevacizumab (Avastin®), are also commonly used in combination with chemotherapy and/or radiotherapy.

Supportive treatment is also frequently used to relieve neurological symptoms and improve neurologic function, and is administered in combination any of the cancer therapies described herein. The primary supportive agents include anticonvulsants and corticosteroids. Thus, the compositions and methods of the present invention may be used in combination with any of the standard or supportive treatments to treat a glioblastoma or astrocytoma.

Non-cancer related diseases and disorders associated with BCMA expression can also be treated by the compositions and methods disclosed herein. Examples of non-cancer related diseases and disorders associated with BCMA expression include, but are not limited to: viral infections; e.g., HIV, fungal invections, e.g., *C. neoformans*; irritable bowel disease; ulcerative colitis, and disorders related to mucosal immunity.

The CAR-modified immune effector cells (e.g., T cells or NK cells) of the present invention may be administered either alone, or as a pharmaceutical composition in combination with diluents and/or with other components such as IL-2 or other cytokines or cell populations.

The present invention provides for compositions and methods for treating cancer. In one aspect, the cancer is a hematologic cancer including but is not limited to hematolical cancer is a leukemia or a lymphoma. In one aspect, the CAR-expressing cells (e.g., CART cells or CAR-expressing NK cells) of the invention may be used to treat cancers and malignancies such as, but not limited to, e.g., acute leukemias including but not limited to, e.g., B-cell acute lymphoid leukemia ("BALL"), T-cell acute lymphoid leukemia ("TALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with BCMA expression includes, but not limited to, e.g., atypical and/or non-classical cancers, malignancies, precancerous conditions or proliferative diseases expressing BCMA.

In embodiments, a composition described herein can be used to treat a disease including but not limited to a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome).

In embodiments, a composition described herein can be used to treat a disease including but not limited to a cancer, e.g., a cancer described herein, e.g., a prostate cancer (e.g., castrate-resistant or therapy-resistant prostate cancer, or metastatic prostate cancer), pancreatic cancer, or lung cancer.

The present invention also provides methods for inhibiting the proliferation or reducing a BCMA-expressing cell population, the methods comprising contacting a population of cells comprising a BMCA-expressing cell with an anti-BCMA CAR-expressing cell (e.g., BCMA CART cell or BCMA CAR-expressing NK cell) of the invention that binds to the BCMA-expressing cell. In a specific aspect, the present invention provides methods for inhibiting the proliferation or reducing the population of cancer cells expressing BCMA, the methods comprising contacting the BCMA-expressing cancer cell population with an anti-BCMA CAR-expressing cell (e.g., BCMA CART cell or BCMA CAR-expressing NK cell) of the invention that binds to the BCMA-expressing cell. In one aspect, the present invention provides methods for inhibiting the proliferation or reducing the population of cancer cells expressing BCMA, the methods comprising contacting the BMCA-expressing cancer cell population with an anti-BCMA CAR-expressing cell (e.g., BCMA CART cell or BCMA CAR-expressing NK cell) of the invention that binds to the BCMA-expressing cell. In certain aspects, the anti-BCMA CAR-expressing cell (e.g., BCMA CART cell or BCMA CAR-expressing NK cell) of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with BCMA-expressing cells relative to a negative control. In one aspect, the subject is a human.

The present invention also provides methods for preventing, treating and/or managing a disease associated with BCMA-expressing cells (e.g., a hematologic cancer or atypical cancer expessing BCMA), the methods comprising administering to a subject in need an anti-BCMA CAR-expressing cell (e.g., BCMA CART cell or BCMA CAR-expressing NK cell) of the invention that binds to the BCMA-expressing cell. In one aspect, the subject is a human. Non-limiting examples of disorders associated with BCMA-expressing cells include viral or fungal infections, and disorders related to mucosal immunity.

The present invention also provides methods for preventing, treating and/or managing a disease associated with BCMA-expressing cells, the methods comprising administering to a subject in need an anti-BCMA CAR-expressing cell (e.g., BCMA CART cell or BCMA CAR-expressing NK cell) of the invention that binds to the BCMA-expressing cell. In one aspect, the subject is a human.

The present invention provides methods for preventing relapse of cancer associated with BCMA-expressing cells, the methods comprising administering to a subject in need thereof an anti-BCMA CAR-expressing cell (e.g., BCMA CART cell or BCMA CAR-expressing NK cell) of the invention that binds to the BCMA-expressing cell. In one aspect, the methods comprise administering to the subject in need thereof an effective amount of an anti-BCMA CAR-expressing cell (e.g., BCMA CART cell or BCMA CAR-expressing NK cell) described herein that binds to the BCMA-expressing cell in combination with an effective amount of another therapy.

Combination Therapies

A CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

The CAR therapy and/or other therapeutic agents, procedures or modalities can be administered during periods of active disorder, or during a period of remission or less active disease. The CAR therapy can be administered before the other treatment, concurrently with the treatment, post-treatment, or during remission of the disorder.

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, a CAR-expressing cell described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation. peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

In one embodiment, a first CAR-expressing cell described herein, e.g., a BCMA CAR-expressing cell described herein, may be used in combination with a second CAR-expressing cell. In one embodiment, the second CAR-expressing cell expresses a CAR comprising a different anti-BMCA binding domain, e.g., an anti-BCMA binding domain described herein that differs from the anti-BCMA binding domain in the CAR expressed by the first CAR-expressing cell. In one embodiment, the second CAR-expressing cell expresses a CAR comprising an antigen-binding domain that targets an antigen other than BCMA (e.g., CD19, CD20, CS-1, kappa light chain, CD139, Lewis Y antigen, or CD38). In one embodiment, a first CAR-expressing cell described herein, e.g., a BCMA CAR-expressing cell described herein, is used in combination with a second CAR-expressing cell comprising a CD19 CAR. In one embodiment, a BCMA CAR-expressing cell described herein is used in combination with a CD19 CAR-expressing cell to treat a BCMA-associated cancer described herein, e.g., multiple myeloma. In some embodiments, the multiple myeloma is CD19-negative, e.g., having a vast majority (e.g., at least 98%, 99%, 99.5%, 99.9%, or 99.95%) of the neoplastic plasma cells with a CD19-negative phenotype, e.g., as detected flow cytometry, RT-PCR, or both flow cytometry and RT-PCR. As shown in Example 17 herein, a CD19 CAR can be effective even against a CD19-negative multiple myeloma. While not wishing to be bound by theory, the CD19 CAR may act on a small but important CD19-positive population of neoplastic cells, by targeting a cell that expresses levels of CD19 that fall below the detection threshold of the assays described herein, or by targeting a non-neoplastic cell that supports the neoplastic cells. In embodiments, a CD19 CAR can remove B cells, e.g., B regulatory B cells.

For example, in one embodiment, the first CAR-expressing cell described herein, e.g., a BCMA CAR-expressing cell, and the second CAR-expressing cell described herein, e.g., a CD19 CAR-expressing cell, are prepared in the same composition and are administered simultaneously. In another embodiment, the first CAR-expressing cell described herein, e.g., a BCMA CAR-expressing cell, and the second CAR-expressing cell described herein, e.g., a CD19 CAR-expressing cell, are prepared in separate compositions, and the separate compositions are administered simultaneously or sequentially. When the BCMA CAR-expressing cell and the second CAR-expressing cell are prepared in separate compositions, the BCMA CAR-expressing cell can be administered first, and the second CAR-expressing cell can be administered second, or the order of administration can be reversed.

In one embodiment, a CD19 CAR is a CD19 CAR, e.g., a humanized CD19 CAR, described in WO2014/153270, filed Mar. 15, 2014 (which is incorporated by reference herein in its entirety) or a sequence at least 95%, e.g., 95-99%, identical thereto. In some embodiments, the CD19 CAR construct is a CAR19 construct provided in PCT publication WO2012/079000 (which is incorporated by reference herein in its entirety) or a sequence at least 95%, e.g., 95-99%, identical thereto. In one embodiment, the anti-CD19 binding domain is a scFv described in WO2012/079000, or a sequence at least 95%, e.g., 95-99%, identical thereto.

In embodiments, a first CAR-expressing cell is administered to a subject, and a second CAR-expressing cell is administered to the subject. In embodiments, the first CAR-expressing cell comprises a CAR (e.g., BCMA or CD19 CAR) comprising a CD27 costimulatory domain and a CD3zeta (mutant or wild type) primary signaling domain. In embodiments, the second CAR-expressing cell comprises a CAR (e.g., BCMA CAR) comprising a 4-1BB costimulatory domain and a CD3zeta (mutant or wild type) primary signaling domain. Without wishing to be bound by theory, in embodiments, the first CAR-expressing cell can be less toxic than the second CAR-expressing cell and be used to debulk a tumor.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)), a *vinca* alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzumab, gemtuzumab, rituximab, tositumomab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General Chemotherapeutic agents considered for use in combination therapies include anastrozole (Arimidex®), bicalutamide (Casodex®), bleomycin sulfate (BLenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Anti-cancer agents of particular interest for combinations with the compounds of the present invention include: anthracyclines; alkylating agents; antimetabolites; drugs that inhibit either the calcium dependent phosphatase calcineurin or the p70S6 kinase FK506) or inhibit the p70S6 kinase; mTOR inhibitors; immunomodulators; anthracyclines; *vinca* alkaloids; proteosome inhibitors; GITR agonists; protein tyrosine phosphatase inhibitors; a CDK4 kinase inhibitor; a BTK inhibitor; a MKN kinase inhibitor; a DGK kinase inhibitor; or an oncolytic virus.

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

Exemplary mTOR inhibitors include, e.g., temsirolimus; ridaforolimus (formally known as deferolimus, (1R,2R,4S)-4-[(2R)-2[(1R,9S,12S,15R,16E,18R,19R,21R, 23S,24E, 26E,28Z,30S,32S,35R)-1,18-dihydroxy-19,30-dimethoxy-15,17,21,23, 29,35-hexamethyl-2,3,10,14,20-pentaoxo-11, 36-dioxa-4-azatricyclo[30.3.1.0$^{4,9}$]hexatriaconta-16,24,26, 28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine- (SEQ ID NO: 383), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary *vinca* alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors include bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

In embodiments, a CAR-expressing cell described herein is administered to a subject in combination with fludarabine, cyclophosphamide, and/or rituximab. In embodiments, a CAR-expressing cell described herein is administered to a subject in combination with fludarabine, cyclophosphamide, and rituximab (FCR). In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the fludarabine is administered at a dosage of about 10-50 mg/m$^2$ (e.g., about 10-15, 15-20, 20-25, 25-30, 30-35, 35-40, 40-45, or 45-50 mg/m$^2$), e.g., intravenously. In embodiments, the cyclophosphamide is administered at a dosage of about 200-300 mg/m$^2$ (e.g., about 200-225, 225-250, 250-275, or 275-300 mg/m$^2$), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with bendamustine and rituximab. In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the bendamustine is administered at a dosage of about 70-110 mg/m2 (e.g., 70-80, 80-90, 90-100, or 100-110 mg/m2), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with rituximab, cyclophosphamide, doxorubicine, vincristine, and/or a corticosteroid (e.g., prednisone). In embodiments, a CAR-expressing cell described herein is administered to a subject in combination with rituximab, cyclophosphamide, doxorubicine, vincristine, and prednisone (R-CHOP). In embodiments, the subject has diffuse large B-cell lymphoma (DLBCL). In embodiments, the subject has nonbulky limited-stage DLBCL (e.g., comprises a tumor having a size/diameter of less than 7 cm). In embodiments, the subject is treated with radiation in combination with the R-CHOP. For example, the subject is administered R-CHOP (e.g., 1-6 cycles, e.g., 1, 2, 3, 4, 5, or 6 cycles of R-CHOP), followed by radiation. In some cases, the subject is administered R-CHOP (e.g., 1-6 cycles, e.g., 1, 2, 3, 4, 5, or 6 cycles of R-CHOP) following radiation.

In embodiments, a CAR-expressing cell described herein is administered to a subject in combination with etoposide, prednisone, vincristine, cyclophosphamide, doxorubicin, and/or rituximab. In embodiments, a CAR-expressing cell described herein is administered to a subject in combination with etoposide, prednisone, vincristine, cyclophosphamide, doxorubicin, and rituximab (EPOCH-R). In embodiments, a CAR-expressing cell described herein is administered to a subject in combination with dose-adjusted EPOCH-R (DA-EPOCH-R). In embodiments, the subject has a B cell lymphoma, e.g., a Myc-rearranged aggressive B cell lymphoma.

In embodiments, a CAR-expressing cell described herein is administered to a subject in combination with rituximab and/or lenalidomide. Lenalidomide ((RS)-3-(4-Amino-1-oxo 1,3-dihydro-2H-isoindol-2-yl)piperidine-2,6-dione) is an immunomodulator. In embodiments, a CAR-expressing cell described herein is administered to a subject in combination with rituximab and lenalidomide. In embodiments, the subject has follicular lymphoma (FL) or mantle cell lymphoma (MCL). In embodiments, the subject has FL and has not previously been treated with a cancer therapy. In embodiments, lenalidomide is administered at a dosage of about 10-20 mg (e.g., 10-15 or 15-20 mg), e.g., daily. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

In embodiments, a CAR-expressing cell described herein is administered to a subject in combination with brentuximab. Brentuximab is an antibody-drug conjugate of anti-CD30 antibody and monomethyl auristatin E. In embodiments, the subject has Hodgkin's lymphoma (HL), e.g., relapsed or refractory HL. In embodiments, the subject comprises CD30+HL. In embodiments, the subject has undergone an autologous stem cell transplant (ASCT). In embodiments, the subject has not undergone an ASCT. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In embodiments, a CAR-expressing cell described herein is administered to a subject in combination with brentuximab and dacarbazine or in combination with brentuximab and bendamustine. Dacarbazine is an alkylating agent with a chemical name of 5-(3,3-Dimethyl-1-triazenyl)imidazole-4-carboxamide. Bendamustine is an alkylating agent with a chemical name of 4-[5-[Bis(2-chloroethyl)amino]-1-methylbenzimidazol-2-yl]butanoic acid. In embodiments, the subject has Hodgkin's lymphoma (HL). In embodiments, the subject has not previously been treated with a cancer therapy. In embodiments, the subject is at least 60 years of age, e.g., 60, 65, 70, 75, 80, 85, or older. In embodiments, dacarbazine is administered at a dosage of about 300-450 mg/m$^2$ (e.g., about 300-325, 325-350, 350-375, 375-400, 400-425, or 425-450 mg/m$^2$), e.g., intravenously. In embodiments, bendamustine is administered at a dosage of about 75-125 mg/m2 (e.g., 75-100 or 100-125 mg/m$^2$, e.g., about 90 mg/m$^2$), e.g., intravenously. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In some embodiments, a CAR-expressing cell described herein is administered to a subject in combination with a CD20 inhibitor, e.g., an anti-CD20 antibody (e.g., an anti-CD20 mono- or bispecific antibody) or a fragment thereof. Exemplary anti-CD20 antibodies include but are not limited to rituximab, ofatumumab, ocrelizumab, veltuzumab, obinutuzumab, TRU-015 (Trubion Pharmaceuticals), ocaratuzumab, and Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in accessdata.fda.gov/drugsatfda_docs/label/2010/103705s53111bl.pdf. In embodiments, a CAR-expressing cell described herein is administered to a subject in combination with rituximab. In embodiments, the subject has CLL or SLL.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab. In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject. In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more. In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some embodiments, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NS0). See, e.g., accessdata.fda.gov/drugsatfda_docs/label/2009/1253261bl.pdf; and Clinical Trial Identifier number NCT01363128, NCT01515176, NCT01626352, and NCT01397591. In embodiments, a CAR-expressing cell described herein is administered to a subject in combination with ofatumumab. In embodiments, the subject has CLL or SLL.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab. In embodiments, ofatumumab is administered at a starting dosage of about 300 mg, followed by 2000 mg, e.g., for about 11 doses, e.g., for 24 weeks. In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some cases, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87.

In some cases, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55.

In some cases, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6(2009):588-96; Clinical Trial Identifier Numbers: NCT01995669, NCT01889797, NCT02229422, and NCT01414205; and accessdata.fda.gov/drugsatfda_docs/label/2013/125486s0001bl.pdf.

In some cases, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25; and Forero-Torres et al. Clin Cancer Res. 18.5(2012):1395-403.

In some cases, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46; and Clinical Trial Identifier No. NCT00452127.

In some cases, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1(2011):13-25. TRU-015 contains an anti-CD20 single-chain variable fragment (scFv) linked to human IgG1 hinge, CH2, and CH3 domains but lacks CH1 and CL domains.

In some embodiments, an anti-CD20 antibody described herein is conjugated or otherwise bound to a therapeutic agent, e.g., a chemotherapeutic agent (e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent), anti-allergic agent, anti-nausea agent (or anti-emetic), pain reliever, or cytoprotective agent described herein.

In embodiments, a CAR-expressing cell described herein is administered to a subject in combination with a B-cell lymphoma 2 (BCL-2) inhibitor (e.g., venetoclax, also called ABT-199 or GDC-0199;) and/or rituximab. In embodiments, a CAR-expressing cell described herein is administered to a subject in combination with venetoclax and rituximab. Venetoclax is a small molecule that inhibits the anti-apoptotic protein, BCL-2. The structure of venetoclax (4-(4-{[2-(4-chlorophenyl)-4,4-dimethylcyclohex-1-en-1-yl]methyl}piperazin-1-yl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide) is shown below.

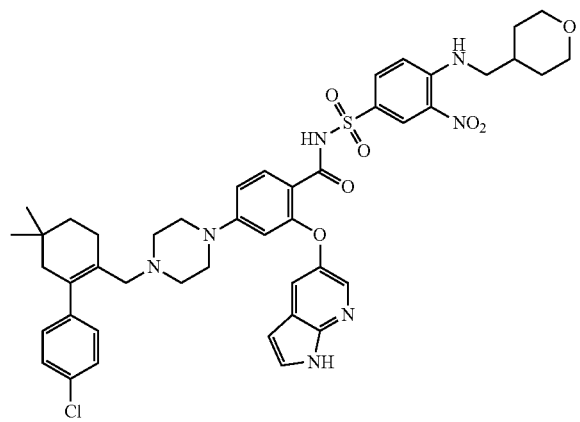 [SMILES: CC1(C)CCC(CN2CCN(c3ccc(C(=O)NS(=O)(=O)c4ccc(NCC5CCOCC5)c([N+](=O)[O-])c4)c(Oc4cnc5[nH]ccc5c4)c3)CC2)=C(c2ccc(Cl)cc2)C1]

In embodiments, the subject has CLL. In embodiments, the subject has relapsed CLL, e.g., the subject has previously been administered a cancer therapy. In embodiments, venetoclax is administered at a dosage of about 15-600 mg (e.g., 15-20, 20-50, 50-75, 75-100, 100-200, 200-300, 300-400, 400-500, or 500-600 mg), e.g., daily. In embodiments, rituximab is administered at a dosage of about 350-550 mg/m2 (e.g., 350-375, 375-400, 400-425, 425-450, 450-475, or 475-500 mg/m2), e.g., intravenously, e.g., monthly.

Without being bound by theory, it is believed that in some cancers, B cells (e.g., B regulatory cells) can suppress T cells. Further, it is believed that a combination of oxiplatin and the B cell depleting agent may reduce tumor size and/or eliminate tumors in a subject. In some embodiments, a CAR-expressing cell described herein (e.g., BCMA CAR) is administered in combination with a B cell depleting agent (e.g., a CD19 CAR-expressing cell, a CD20 CAR-expressing cell, rituximab, ocrelizumab, epratuzumab, or belimumab) and oxiplatin. In embodiments, the cancer cell can be CD19 negative or CD19 positive; or BCMA negative or BMCA positive. In embodiments, a CAR-expressing cell described herein (e.g., BCMA CAR) is administered in combination with a B cell depleting agent and oxiplatin to treat a cancer, e.g., a cancer described herein, e.g., solid cancer, e.g., prostate cancer, pancreatic cancer, or lung cancer.

In embodiments, a CAR-expressing cell described herein (e.g., BCMA CAR) may deplete B cells (e.g., B cells having a plasma cell-like phenotype, e.g., that express BCMA, CD19, and/or CD20) in a subject. In embodiments, the B cell can be CD19 negative or CD19 positive; or BCMA negative or BMCA positive. In some embodiments, a CAR-expressing cell described herein (e.g., BCMA CAR) is administered in combination with oxiplatin. In embodiments, a CAR-expressing cell described herein is administered in combination with oxiplatin is used to treat a cancer, e.g., solid cancer, e.g., prostate cancer, pancreatic cancer, or lung cancer. In some embodiments, a CAR-expressing cell described herein is administered in combination with an oncolytic virus. In embodiments, oncolytic viruses are capable of selectively replicating in and triggering the death of or slowing the growth of a cancer cell. In some cases, oncolytic viruses have no effect or a minimal effect on non-cancer cells. An oncolytic virus includes but is not limited to an oncolytic adenovirus, oncolytic Herpes Simplex Viruses, oncolytic retrovirus, oncolytic parvovirus, oncolytic vaccinia virus, oncolytic Sinbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

In some embodiments, the oncolytic virus is a virus, e.g., recombinant oncolytic virus, described in US2010/0178684 A1, which is incorporated herein by reference in its entirety. In some embodiments, a recombinant oncolytic virus comprises a nucleic acid sequence (e.g., heterologous nucleic acid sequence) encoding an inhibitor of an immune or inflammatory response, e.g., as described in US2010/0178684 A1, incorporated herein by reference in its entirety. In embodiments, the recombinant oncolytic virus, e.g., oncolytic NDV, comprises a pro-apoptotic protein (e.g., apoptin), a cytokine (e.g., GM-CSF, interferon-gamma, interleukin-2 (IL-2), tumor necrosis factor-alpha), an immunoglobulin (e.g., an antibody against ED-B fibronectin), tumor associated antigen, a bispecific adapter protein (e.g., bispecific antibody or antibody fragment directed against NDV HN protein and a T cell co-stimulatory receptor, such as CD3 or CD28; or fusion protein between human IL-2 and single chain antibody directed against NDV HN protein). See, e.g., Zamarin et al. Future Microbiol. 7.3(2012):347-67, incorporated herein by reference in its entirety. In some embodiments, the oncolytic virus is a chimeric oncolytic NDV described in U.S. Pat. No. 8,591,881 B2, US 2012/0122185 A1, or US 2014/0271677 A1, each of which is incorporated herein by reference in their entireties.

In some embodiments, the oncolytic virus comprises a conditionally replicative adenovirus (CRAd), which is designed to replicate exclusively in cancer cells. See, e.g., Alemany et al. Nature Biotechnol. 18(2000):723-27. In some embodiments, an oncolytic adenovirus comprises one described in Table 1 on page 725 of Alemany et al., incorporated herein by reference in its entirety.

Exemplary oncolytic viruses include but are not limited to the following:

Group B Oncolytic Adenovirus (ColoAd1) (PsiOxus Therapeutics Ltd.) (see, e.g., Clinical Trial Identifier: NCT02053220);

ONCOS-102 (previously called CGTG-102), which is an adenovirus comprising granulocyte-macrophage colony stimulating factor (GM-CSF) (Oncos Therapeutics) (see, e.g., Clinical Trial Identifier: NCT01598129);

VCN-01, which is a genetically modified oncolytic human adenovirus encoding human PH20 hyaluronidase (VCN Biosciences, S.L.) (see, e.g., Clinical Trial Identifiers: NCT02045602 and NCT02045589);

Conditionally Replicative Adenovirus ICOVIR-5, which is a virus derived from wild-type human adenovirus serotype 5 (Had5) that has been modified to selectively replicate in cancer cells with a deregulated retinoblastoma/E2F pathway (Institut Català d'Oncologia) (see, e.g., Clinical Trial Identifier: NCT01864759);

Celyvir, which comprises bone marrow-derived autologous mesenchymal stem cells (MSCs) infected with ICOVIR5, an oncolytic adenovirus (Hospital Infantil Universitario Niño Jesús, Madrid, Spain/Ramon Alemany) (see, e.g., Clinical Trial Identifier: NCT01844661);

CG0070, which is a conditionally replicating oncolytic serotype 5 adenovirus (Ad5) in which human E2F-1 promoter drives expression of the essential E1a viral genes, thereby restricting viral replication and cytotoxicity to Rb pathway-defective tumor cells (Cold Genesys, Inc.) (see, e.g., Clinical Trial Identifier: NCT02143804); or DNX-2401 (formerly named Delta-24-RGD), which is an adenovirus that has been engineered to replicate selectively in retinoblastoma (Rb)-pathway deficient cells and to infect cells that express certain RGD-binding integrins more efficiently (Clinica Universidad de Navarra, Universidad de Navarra/DNAtrix, Inc.) (see, e.g., Clinical Trial Identifier: NCT01956734).

In some embodiments, an oncolytic virus described herein is administering by injection, e.g., subcutaneous, intra-arterial, intravenous, intramuscular, intrathecal, or intraperitoneal injection. In embodiments, an oncolytic virus described herein is administered intratumorally, transdermally, transmucosally, orally, intranasally, or via pulmonary administration.

In an embodiment, cells expressing a CAR described herein are administered to a subject in combination with a molecule that decreases the Treg cell population. Methods that decrease the number of (e.g., deplete) Treg cells are known in the art and include, e.g., CD25 depletion, cyclophosphamide administration, modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse. In one embodiment, a CAR expressing cell described herein is administered to a subject in combination with a a molecule targeting GITR and/or modulating GITR functions, such as a GITR agonist and/or a GITR antibody that depletes regulatory T cells (Tregs). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to aphersis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as multiple myeloma, ALL or CLL). In an embodiment, the subject has CLL. In embodiments, the subject has multiple myeloma. In embodiments, the subject has a solid cancer, e.g., a solid cancer described herein. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. No. 7,812,135, U.S. Pat. No. 8,388,967, U.S. Pat. No. 8,591,886, European Patent No.: EP 1866339, PCT Publication No.: WO 2011/028683, PCT Publication No.: WO 2013/039954, PCT Publication No.:

WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with an mTOR inhibitor, e.g., an mTOR inhibitor described herein, e.g., a rapalog such as everolimus. In one embodiment, the mTOR inhibitor is administered prior to the CAR-expressing cell. For example, in one embodiment, the mTOR inhibitor can be administered prior to apheresis of the cells.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells.

In one embodiment, a CAR expressing cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment, a CAR-expressing cell described herein can be used in combination with a kinase inhibitor. In one embodiment, the kinase inhibitor is a CDK4 inhibitor, e.g., a CDK4 inhibitor described herein, e.g., a CDK4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d]pyrimidine. The MNK inhibitor can be, e.g., a MNK1a, MNK1b, MNK2a and/or MNK2b inhibitor. In one embodiment, the kinase inhibitor is a dual PI3K/mTOR inhibitor described herein, such as, e.g., PF-04695102. In one embodiment, the kinase inhibitor is a DGK inhibitor, e.g., a DGK inhibitor described herein, such as, e.g., DGKinh1 (D5919) or DGKinh2 (D5794).

In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2] benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In embodiments, a CAR-expressing cell described herein is administered to a subject in combination with a cyclin-dependent kinase (CDK) 4 or 6 inhibitor, e.g., a CDK4 inhibitor or a CDK6 inhibitor described herein. In embodiments, a CAR-expressing cell described herein is administered to a subject in combination with a CDK4/6 inhibitor (e.g., an inhibitor that targets both CDK4 and CDK6), e.g., a CDK4/6 inhibitor described herein. In an embodiment, the subject has MCL. MCL is an aggressive cancer that is poorly responsive to currently available therapies, i.e., essentially incurable. In many cases of MCL, cyclin D1 (a regulator of CDK4/6) is expressed (e.g., due to chromosomal translocation involving immunoglobulin and Cyclin D1 genes) in MCL cells. Thus, without being bound by theory, it is thought that MCL cells are highly sensitive to CDK4/6 inhibition with high specificity (i.e., minimal effect on normal immune cells). CDK4/6 inhibitors alone have had some efficacy in treating MCL, but have only achieved partial remission with a high relapse rate. An exemplary CDK4/6 inhibitor is LEE011 (also called ribociclib), the structure of which is shown below.

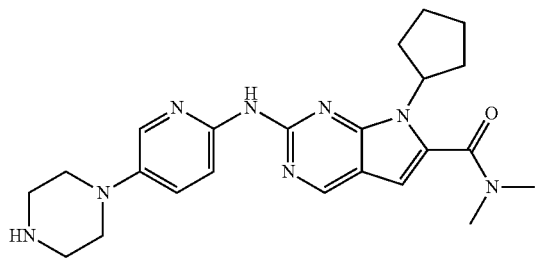 [SMILES: CN(C)C(=O)c1cc2cnc(Nc3ccc(N4CCNCC4)cn3)nc2n1C1CCCC1]

Without being bound by theory, it is believed that administration of a CAR-expressing cell described herein with a CDK4/6 inhibitor (e.g., LEE011 or other CDK4/6 inhibitor described herein) can achieve higher responsiveness, e.g., with higher remission rates and/or lower relapse rates, e.g., compared to a CDK4/6 inhibitor alone.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In a preferred embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In embodiments, a CAR-expressing cell described herein is administered to a subject in combination with a BTK inhibitor (e.g., ibrutinib). In embodiments, a CAR-expressing cell described herein is administered to a subject in combination with ibrutinib (also called PCI-32765). The structure of ibrutinib (1-[(3R)-3-[4-Amino-3-(4-phenoxyphenyl)-1H-pyrazolo[3,4-d]pyrimidin-1-yl]piperidin-1-yl]prop-2-en-1-one) is shown below.

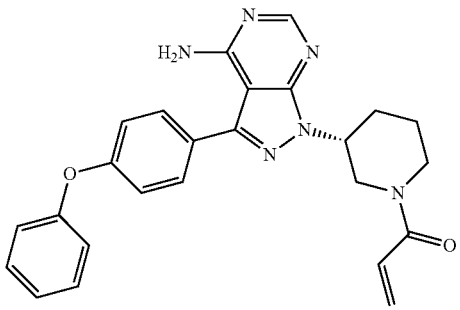 [SMILES: C=CC(=O)N1CCC[C@@H](n2nc(-c3ccc(Oc4ccccc4)cc3)c3c(N)ncnc32)C1]

In embodiments, the subject has CLL, mantle cell lymphoma (MCL), or small lymphocytic lymphoma (SLL). For example, the subject has a deletion in the short arm of chromosome 17 (del(17p), e.g., in a leukemic cell). In other examples, the subject does not have a del(17p). In embodiments, the subject has relapsed CLL or SLL, e.g., the subject has previously been administered a cancer therapy (e.g., previously been administered one, two, three, or four prior cancer therapies). In embodiments, the subject has refractory CLL or SLL. In other embodiments, the subject has follicular lymphoma, e.g., relapse or refractory follicular lymphoma. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle cycle, or daily for 28 day cycle. In one embodiment, 1, 2, 3, 4, 5, 6, 7, 8, 9, 10, 11, 12 or more cycles of ibrutinib are administered. In some embodiments, ibrutinib is administered in combination with rituximab. See, e.g., Burger et al. (2013) Ibrutinib In Combination With Rituximab (iR) Is Well Tolerated and Induces a High Rate Of Durable Remissions In Patients With High-Risk Chronic Lymphocytic Leukemia (CLL): New, Updated Results Of a Phase II Trial In 40 Patients, Abstract 675 presented at 55th ASH Annual Meeting and Exposition, New Orleans, La. 7-10 December. Without being bound by theory, it is thought that the addition of ibrutinib enhances the T cell proliferative response and may shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses.

In some embodiments of the methods, uses, and compositions herein, the BTK inhibitor is a BTK inhibitor described in International Application WO/2015/079417, which is herein incorporated by reference in its entirety. For instance, in some embodiments, the BTK inhibitor is a compound of formula (I) or a pharmaceutically acceptable salt thereof;

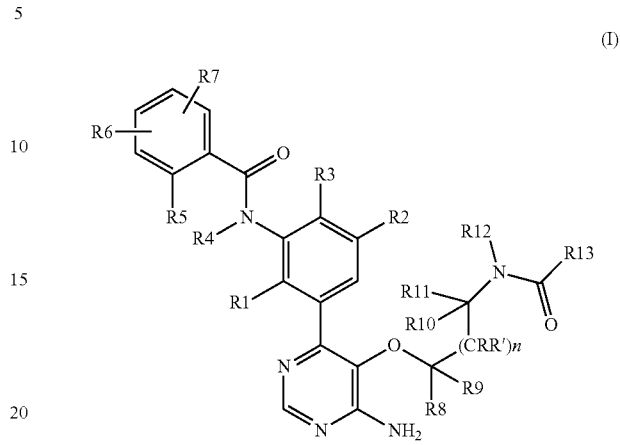

wherein,
R1 is hydrogen, C1-C6 alkyl optionally substituted by hydroxy;
R2 is hydrogen or halogen;
R3 is hydrogen or halogen;
R4 is hydrogen;
R5 is hydrogen or halogen;
or R4 and R5 are attached to each other and stand for a bond, —CH2-, -CH2-CH2-, —CH═CH—, —CH═CH—CH2-; -CH2-CH═CH—; or —CH2-CH2-CH2-;
R6 and R7 stand independently from each other for H, C1-C6 alkyl optionally substituted by hydroxyl, C3-C6 cycloalkyl optionally substituted by halogen or hydroxy, or halogen;
R8, R9, R, R', R10 and R11 independently from each other stand for H, or C1-C6 alkyl optionally substituted by C1-C6 alkoxy; or any two of R8, R9, R, R', R10 and R11 together with the carbon atom to which they are bound may form a 3-6 membered saturated carbocyclic ring;
R12 is hydrogen or C1-C6 alkyl optionally substituted by halogen or C1-C6 alkoxy;
or R12 and any one of R8, R9, R, R', R10 or R11 together with the atoms to which they are bound may form a 4, 5, 6 or 7 membered azacyclic ring, which ring may optionally be substituted by halogen, cyano, hydroxyl, C1-C6 alkyl or C1-C6 alkoxy;
n is 0 or 1; and
R13 is C2-C6 alkenyl optionally substituted by C1-C6 alkyl, C1-C6 alkoxy or N,N-di-C1-C6 alkyl amino; C2-C6 alkynyl optionally substituted by C1-C6 alkyl or C1-C6 alkoxy; or C2-C6 alkylenyl oxide optionally substituted by C1-C6 alkyl.

In some embodiments, the BTK inhibitor of Formula I is chosen from: N-(3-(5-((1-Acryloylazetidin-3-yl)oxy)-6-aminopyrimidin-4-yl)-5-fluoro-2-methylphenyl)-4-cyclopropyl-2-fluorobenzamide; (E)-N-(3-(6-Amino-5-((1-(but-2-enoyl)azetidin-3-yl)oxy)pyrimidin-4-yl)-5-fluoro-2-methylphenyl)-4-cyclopropyl-2-fluorobenzamide; N-(3-(6-Amino-5-((1-propioloylazetidin-3-yl)oxy)pyrimidin-4-yl)-5-fluoro-2-methylphenyl)-4-cyclopropyl-2-fluorobenzamide; N-(3-(6-Amino-5-((1-(but-2-ynoyl)azetidin-3-yl)oxy)pyrimidin-4-yl)-5-fluoro-2-methylphenyl)-4-cyclopropyl-2-fluorobenzamide; N-(3-(5-((1-Acryloylpiperidin-4-yl)oxy)-6-aminopyrimidin-4-yl)-5- fluoro-2-methylphenyl)-4-cyclopropyl-2-fluorobenzamide; N-(3-(6-Amino-5-(2-(N-methylacrylamido)ethoxy)pyrimidin-4-yl)-5-fluoro-2-methylphenyl)-4-cyclopropyl-2-fluorobenzamide; (E)-N-(3-(6-Amino-5-(2-(N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylpropiolamido)ethoxy)pyrimidin-4-yl)-5-fluoro-2-methylphenyl)-4-cyclopropyl-2-fluorobenzamide; (E)-N-(3-(6-Amino-5-(2-(4-methoxy-N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylbut-2-ynamido)ethoxy)pyrimidin-4-yl)-5-fluoro-2-methylphenyl)-4-cyclopropyl-2-fluorobenzamide; N-(2-((4-Amino-6-(3-(4-cyclopropyl-2-fluorobenzamido)-5-fluoro-2-methylphenyl)pyrimidin-5-yl)oxy)ethyl)-N-methyloxirane-2-carboxamide; N-(2-((4-Amino-6-(3-(6-cyclopropyl-8-fluoro-1-oxoisoquinolin-2(1H)-yl)phenyl)pyrimidin-5-yl)oxy)ethyl)-N-methylacrylamide; N-(3-(5-(2-Acrylamidoethoxy)-6-aminopyrimidin-4-yl)-5-fluoro-2-methylphenyl)-4-cyclopropyl-2-fluorobenzamide; N-(3-(6-Amino-5-(2-(N-ethylacrylamido)ethoxy)pyrimidin-4-yl)-5-fluoro-2-methylphenyl)-4-cyclopropyl-2-fluorobenzamide; N-(3-(6-Amino-5-(2-(N-(2-fluoroethyl)acrylamido)ethoxy)pyrimidin-4-yl)-5-fluoro-2-methylphenyl)-4-cyclopropyl-2-fluorobenzamide; N-(3-(5-((1-Acrylamidocyclopropyl)methoxy)-6-aminopyrimidin-4-yl)-5-fluoro-2-methylphenyl)-4-cyclopropyl-2-fluorobenzamide; (S)—N-(3-(5-(2-Acrylamidopropoxy)-6-aminopyrimidin-4-yl)-5-fluoro-2-methylphenyl)-4-cyclopropyl-2-fluorobenzamide; (S)—N-(3-(6-Amino-5-(2-(but-2-ynamido)propoxy)pyrimidin-4-yl)-5-fluoro-2-methylphenyl)-4-cyclopropyl-2-fluorobenzamide; (S)—N-(3-(6-Amino-5-(2-(N-methylacrylamido)propoxy)pyrimidin-4-yl)-5-fluoro-2-methylphenyl)-4-cyclopropyl-2-fluorobenzamide; (S)—N-(3-(6-Amino-5-(2-(N-methylbut-2-ynamido)propoxy)pyrimidin-4-yl)-5-fluoro-2-methylphenyl)-4-cyclopropyl-2-fluorobenzamide; N-(3-(6-Amino-5-(3-(N-methylacrylamido)propoxy)pyrimidin-4-yl)-5-fluoro-2-methylphenyl)-4-cyclopropyl-2-fluorobenzamide; (S)—N-(3-(5-((1-Acryloylpyrrolidin-2-yl)methoxy)-6-aminopyrimidin-4-yl)-5-fluoro-2-methylphenyl)-4-cyclopropyl-2-fluorobenzamide; (S)—N-(3-(6-Amino-5-((1-(but-2-ynoyl)pyrrolidin-2-yl)methoxy)pyrimidin-4-yl)-5-fluoro-2-methylphenyl)-4-cyclopropyl-2-fluorobenzamide; (S)-2-(3-(5-((1-Acryloylpyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(2-((4-Amino-6-(3-(6-cyclopropyl-1-oxo-3,4-dihydroisoquinolin-2(1H)-yl)-5-fluoro-2-(hydroxymethyl)phenyl)pyrimidin-5-yl)oxy)ethyl)-N-methylacrylamide; N-(3-(5-(((2S,4R)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; 2-(3-(5-(((2S,4R)-1-Acryloyl-4-methoxypyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(3-(5-(((2S,4S)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4S)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; N-(3-(5-(((2S,4R)-1-Acryloyl-4-fluoropyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-fluoropyrrolidin-2-yl)methoxy)pyrimidin-4-yl)-5-fluoro-2-methylphenyl)-4-cyclopropyl-2-fluorobenzamide; (S)—N-(3-(5-((1-Acryloylazetidin-2-yl)methoxy)-6-aminopyrimidin-4-yl)-5-fluoro-2-methylphenyl)-4-cyclopropyl-2-fluorobenzamide; (S)—N-(3-(6-Amino-5-((1-propioloylazetidin-2-yl)methoxy)pyrimidin-4-yl)-5-fluoro-2-methylphenyl)-4-cyclopropyl-2-fluorobenzamide; (S)-2-(3-(5-((1-Acryloylazetidin-2-yl)methoxy)-6-aminopyrimidin-4-yl)-5-fluoro-2-(hydroxymethyl)phenyl)-6-cyclopropyl-3,4-dihydroisoquinolin-1(2H)-one; (R)—N-(3-(5-((1-Acryloylazetidin-2-yl)methoxy)-6-aminopyrimidin-4-yl)-5-fluoro-2-methylphenyl)-4-cyclopropyl-2-fluorobenzamide; (R)—N-(3-(5-((1-Acryloylpiperidin-3-yl)methoxy)-6-aminopyrimidin-4-yl)-5-fluoro-2-methylphenyl)-4-cyclopropyl-2-fluorobenzamide; N-(3-(5-(((2R,3S)-1-Acryloyl-3-methoxypyrrolidin-2-yl)methoxy)-6-aminopyrimidin-4-yl)-5-fluoro-2-methylphenyl)-4-cyclopropyl-2-fluorobenzamide; N-(3-(5-(((2S,4R)-1-Acryloyl-4-cyanopyrrolidin-2-yl)methoxy)-6-aminopyrimidin-4-yl)-5-fluoro-2-methylphenyl)-4-cyclopropyl-2-fluorobenzamide; or N-(3-(5-(((2S,4S)-1-Acryloyl-4-cyanopyrrolidin-2-yl)methoxy)-6-aminopyrimidin-4-yl)-5-fluoro-2-methylphenyl)-4-cyclopropyl-2-fluorobenzamide.

Unless otherwise provided, the chemical terms used above in describing the BTK inhibitor of Formula I are used according to their meanings as set out in International Application WO/2015/079417, which is herein incorporated by reference in its entirety.

In one embodiment, the kinase inhibitor is an mTOR inhibitor selected from temsirolimus; ridaforolimus (1R,2R,4S)-4-[(2R)-2[(1R,9S,12S,15R,16E,18R,19R,21R, 23S, 24E,26E,28Z,30S,32S,35R)-1,18-dihydroxy-19,30-dimethoxy-15,17,21,23, 29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-amino-8-[trans-4-(2-hydroxyethoxy)cyclohexyl]-6-(6-methoxy-3-pyridinyl)-4-methylpyrido[2,3-d]pyrimidin-7(8H)-one (PF04691502); and N$^2$-[1,4-dioxo-4-[[4-(4-oxo-8-phenyl-4H-1-benzopyran-2-yl)morpholinium-4-yl]methyl]butyl]-L-arginylglycyl-L-α-aspartylL-serine- (SEQ ID NO: 383), inner salt (SF1126); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo [3,4-d] pyrimidine (CGP57380); cercosporamide; ETC-1780445-2; and 4-amino-5-(4-fluoroanilino)-pyrazolo [3,4-d] pyrimidine.

In embodiments, a CAR-expressing cell described herein is administered to a subject in combination with a phosphoinositide 3-kinase (PI3K) inhibitor (e.g., a PI3K inhibitor described herein, e.g., idelalisib or duvelisib) and/or rituximab. In embodiments, a CAR-expressing cell described herein is administered to a subject in combination with idelalisib and rituximab. In embodiments, a CAR-expressing cell described herein is administered to a subject in combination with duvelisib and rituximab. Idelalisib (also called GS-1101 or CAL-101; Gilead) is a small molecule that blocks the delta isoform of PI3K. The structure of idelalisib (5-Fluoro-3-phenyl-2-[(1S)-1-(7H-purin-6-ylamino)propyl]-4(3H)-quinazolinone) is shown below.

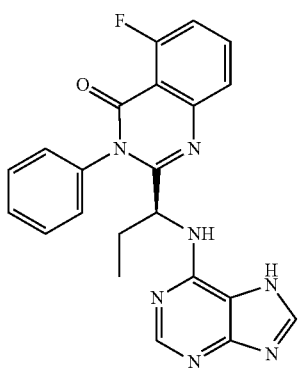 [SMILES: CC[C@H](Nc1ncnc2nc[nH]c12)c1nc2cccc(F)c2c(=O)n1-c1ccccc1]

Duvelisib (also called IPI-145; Infinity Pharmaceuticals and Abbvie) is a small molecule that blocks PI3K-δ,γ. The structure of duvelisib (8-Chloro-2-phenyl-3-[(1S)-1-(9H-purin-6-ylamino)ethyl]-1(2H)-isoquinolinone) is shown below.

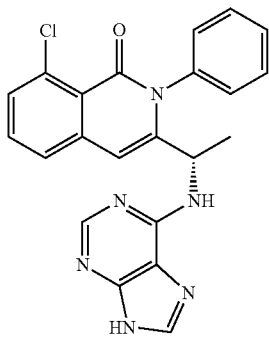 [SMILES: C[C@H](Nc1ncnc2[nH]cnc12)c1cc2cccc(Cl)c2c(=O)n1-c1ccccc1]

In embodiments, the subject has CLL. In embodiments, the subject has relapsed CLL, e.g., the subject has previously been administered a cancer therapy (e.g., previously been administered an anti-CD20 antibody or previously been administered ibrutinib). For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the subject has a deletion in the long arm of chromosome 11 (del(11q)). In other embodiments, the subject does not have a del(11q). In embodiments, idelalisib is administered at a dosage of about 100-400 mg (e.g., 100-125, 125-150, 150-175, 175-200, 200-225, 225-250, 250-275, 275-300, 325-350, 350-375, or 375-400 mg), e.g., BID. In embodiments, duvelisib is administered at a dosage of about 15-100 mg (e.g., about 15-25, 25-50, 50-75, or 75-100 mg), e.g., twice a day. In embodiments, rituximab is administered at a dosage of about 350-550 mg/m² (e.g., 350-375, 375-400, 400-425, 425-450, 450-475, or 475-500 mg/m²), e.g., intravenously.

In embodiments, a CAR-expressing cell described herein is administered to a subject in combination with an anaplastic lymphoma kinase (ALK) inhibitor. Exemplary ALK kinases include but are not limited to crizotinib (Pfizer), ceritinib (Novartis), alectinib (Chugai), brigatinib (also called AP26113; Ariad), entrectinib (Ignyta), PF-06463922 (Pfizer), TSR-011 (Tesaro) (see, e.g., Clinical Trial Identifier No. NCT02048488), CEP-37440 (Teva), and X-396 (Xcovery). In some embodiments, the subject has a solid cancer, e.g., a solid cancer described herein, e.g., lung cancer.

The chemical name of crizotinib is 3-[(1R)-1-(2,6-dichloro-3-fluorophenyl)ethoxy]-5-(1-piperidin-4-ylpyrazol-4-yl)pyridin-2-amine. The chemical name of ceritinib is 5-Chloro-N²-[2-isopropoxy-5-methyl-4-(4-piperidinyl)phenyl]-N⁴-[2-(isopropylsulfonyl)phenyl]-2,4-pyrimidinediamine. The chemical name of alectinib is 9-ethyl-6,6-dimethyl-8-(4-morpholinopiperidin-1-yl)-11-oxo-6,11-dihydro-5H-benzo[b]carbazole-3-carbonitrile. The chemical name of brigatinib is 5-Chloro-N²-{4-[4-(dimethylamino)-1-piperidinyl]-2-methoxyphenyl}-N⁴-[2-(dimethylphosphoryl)phenyl]-2,4-pyrimidinediamine. The chemical name of entrectinib is N-(5-(3,5-difluorobenzyl)-1H-indazol-3-yl)-4-(4-methylpiperazin-1-yl)-2-((tetrahydro-2H-pyran-4-yl)amino)benzamide. The chemical name of PF-06463922 is (10R)-7-Amino-12-fluoro-2,10,16-trimethyl-15-oxo-10,15,16,17-tetrahydro-2H-8,4-(metheno)pyrazolo[4,3-h][2,5,11]-benzoxadiazacyclotetradecine-3-carbonitrile. The chemical structure of CEP-37440 is (S)-2-((5-chloro-2-((6-(4-(2-hydroxyethyl)piperazin-1-yl)-1-methoxy-6,7,8,9-tetrahydro-5H-benzo[7]annulen-2-yl)amino)pyrimidin-4-yl)amino)-N-methylbenzamide. The chemical name of X-396 is (R)-6-amino-5-(1-(2,6-dichloro-3-fluorophenyl)ethoxy)-N-(4-(4-methylpiperazine-1-carbonyl)phenyl)pyridazine-3-carboxamide.

In one embodiment, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl]phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl]phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991;

Henderson et al., Immun. 73:316-321, 1991; Bierer et al., Curr. Opin. Immun. 5:763-773, 1993) can also be used. In a further aspect, the cell compositions of the present invention may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

In one embodiment, a CAR expressing cell described herein is administered to a subject in combination with a biphosphonate, e.g., Pamidronate (Aredia®); Zoledronic acid or Zoledronate (Zometa®, Zomera®, Aclasta®, or Reclast®); Alendronate (Fosamax®); Risedronate (Actonel®); Ibandronate (Boniva®); Clondronate (Bonefos®); Etidronate (Didronel®); Tiludronate (Skelid®); Pamidronate (Aredia®); Neridronate (Nerixia®); Strontiun ranelate (Protelos®, or Protos®); and Teriparatide (Forteo®).

In one embodiment, a CAR expressing cell described herein is administered to a subject in combination with a corticosteroid, e.g., dexamethasone (e.g., Decadron®), beclomethasone (e.g., Beclovent®), hydrocortisone (also known as cortisone, hydrocortisone sodium succinate, hydrocortisone sodium phosphate, and sold under the tradenames Ala-Cort®, hydrocortisone phosphate, Solu-Cortef®, Hydrocort Acetate® and Lanacort®), prednisolone (sold under the tradenames Delta-Cortel®, Orapred®, Pediapred® and Prelone®), prednisone (sold under the tradenames Deltasone®, Liquid Red®, Meticorten® and Orasone®), methylprednisolone (also known as 6-methylprednisolone, methylprednisolone acetate, methylprednisolone sodium succinate, sold under the tradenames Duralone®, Medralone®, Medrol®, M-Prednisol® and Solu-Medrol®); antihistamines, such as diphenhydramine (e.g., Benadryl®), hydroxyzine, and cyproheptadine; and bronchodilators, such as the beta-adrenergic receptor agonists, albuterol (e.g., Proventil®), and terbutaline (Brethine®).

In one embodiment, a CAR expressing cell described herein is administered to a subject in combination with an immunomodulator, e.g., Afutuzumab (available from Roche®); Pegfilgrastim (Neulasta®); Lenalidomide (CC-5013, Revlimid®); Thalidomide (Thalomid®), Actimid (CC4047); and IRX-2 (mixture of human cytokines including interleukin 1, interleukin 2, and interferon γ, CAS 951209-71-5, available from IRX Therapeutics.

In one embodiment, a CAR expressing cell described herein is administered to a subject in combination with a proteasome inhibitor, e.g., Bortezomib (Velcade®); Ixazomib citrate (MLN9708, CAS 1201902-80-8); Danoprevir (RG7227, CAS 850876-88-9); Ixazomib (MLN2238, CAS 1072833-77-2); and (S)—N-[(phenylmethoxy)carbonyl]-L-leucyl-N-(1-formyl-3-methylbutyl)-L-Leucinamide (MG-132, CAS 133407-82-6).

In one embodiment, a CAR expressing cell described herein is administered to a subject in combination with a vascular endothelial growth factor (VEGF) receptor, e.g., Bevacizumab (Avastin®), axitinib (Inlyta®); Brivanib alaninate (BMS-582664, (S)—((R)-1-(4-(4-Fluoro-2-methyl-1H-indol-5-yloxy)-5-methylpyrrolo[2,1-f][1,2,4]triazin-6-yloxy)propan-2-yl)2-aminopropanoate); Sorafenib (Nexavar®); Pazopanib (Votrient®); Sunitinib malate (Sutent®); Cediranib (AZD2171, CAS 288383-20-1); Vargatef (BIBF1120, CAS 928326-83-4); Foretinib (GSK1363089); Telatinib (BAY57-9352, CAS 332012-40-5); Apatinib (YN968D1, CAS 811803-05-1); Imatinib (Gleevec®); Ponatinib (AP24534, CAS 943319-70-8); Tivozanib (AV951, CAS 475108-18-0); Regorafenib (BAY73-4506, CAS 755037-03-7); Vatalanib dihydrochloride (PTK787, CAS 212141-51-0); Brivanib (BMS-540215, CAS 649735-46-6); Vandetanib (Caprelsa® or AZD6474); Motesanib diphosphate (AMG706, CAS 857876-30-3, N-(2, 3-dihydro-3,3-dimethyl-1H-indol-6-yl)-2-[(4-pyridinylmethyl)amino]-3-pyridinecarboxamide, described in PCT Publication No. WO 02/066470); Dovitinib dilactic acid (TKI258, CAS 852433-84-2); Linfanib (ABT869, CAS 796967-16-3); Cabozantinib (XL184, CAS 849217-68-1); Lestaurtinib (CAS 111358-88-4); N-[5-[[[5-(1,1-Dimethylethyl)-2-oxazolyl]methyl]thio]-2-thiazolyl]-4-piperidinecarboxamide (BMS38703, CAS 345627-80-7); (3R,4R)-4-Amino-1-((4-((3-methoxyphenyl)amino)pyrrolo[2,1-f][1,2,4]triazin-5-yl)methyl)piperidin-3-ol (BMS690514); N-(3,4-Dichloro-2-fluorophenyl)-6-methoxy-7-[[(3aα, 5β,6aα)-octahydro-2-methylcyclopenta[c]pyrrol-5-yl]methoxy]-4-quinazolinamine (XL647, CAS 781613-23-8); 4-Methyl-3-[[1-methyl-6-(3-pyridinyl)-1H-pyrazolo[3,4-d]pyrimidin-4-yl]amino]-N-[3-(trifluoromethyl)phenyl]-benzamide (BHG712, CAS 940310-85-0); and Aflibercept (Eylea®).

In one embodiment, a CAR expressing cell described herein is administered to a subject in combination with a CD20 antibody or a conjugate thereof, e.g.: Rituximab (Riuxan® and MabThera®); and Tositumomab (Bexxar®); and Ofatumumab (Arzerra®), Ibritumomab tiuxetan (Zevalin®); and Tositumomab, In one embodiment, a CAR expressing cell described herein is administered to a subject in combination with an anticonvulsant, e.g., Anticonvulsants (antiepileptic or anti-seizure drugs): aldehydes, e.g., paraldehyde; aromatic allylic alcohols, e.g., stiripentol (Diacomit®); barbiturates, e.g., phenobarbital (Luminal®), methylphenobarbital (Mebaral®), barbexaclone (Maliasin®), benzodiazepines, e.g., clobazam (Onfi®), clonazepam (Klonopin®), clorazepate (Tranxene® and Novo-Clopate®), diazepam (Valium®, Lembrol®, Diastat®), midazolam (Versed®), lorazepam (Ativan® and Orfidal®), nitrazepam (Alodorm®, Arem®, Insoma®), temazepam (Restoril®, Normison®), nimetzepam (Erimin®), bromides, e.g., potassium bromide; carbamates, e.g., felbamate (Felbatol®); carboxamides, e.g., carbamazepine (Tegretol®, Equetro®), oxcarbazepine (Trileptal®, Oxcarb®), eslicarbazepine acetate (Aptiom®); fatty acids, e.g., valproates (valproic acid, sodium valproate, divalproex sodium), vigabatrin (Sabril®), progabide (Gabren®), tiagabine (Gabitril®); fructose derivatives, e.g., topiramate (Topamax®); GABA analogs, e.g., gabapentin (Neurontin®), pregabalin (Lyrica®); hydantoins, e.g., ethotoin (Peganone®), phenytoin (Dilantin®), mephenytoin (Mesantoin®), fosphenytoin (Cerebyx®, Prodilantin®); oxazolidinediones, e.g., paramethadione (Paradione®), trimethadione (Tridione®); propionates, e.g., beclamide (Choracon®, Hibicon®, Posedrine®); pyrimidinediones, e.g., primidone (Mysoline®); pyrrolidines, e.g., brivaracetam, levetiracetam, seletracetam (Keppra®); succinimides, e.g., ethosuximide (Zarontin®), phensuximide (Milontin®), mesuximide (Celontin®, Petinutin®); sulfonamides, e.g., acetazolamide (Diamox®), sultiame (Ospolot®), methazolamide (Neptazane®), zonisamide (Zonegran®); triazines, e.g., lamotrigine (Lamictal®); ureas, e.g., pheneturide, phenacemide (Phenurone®); valproylamides (amide derivatives of valproate), e.g., valpromide (Depamide®), valnoctamide; AMPA receptor antagonist, e.g., perampanel (Fycompa®).

In embodiments, a CAR-expressing cell described herein is administered to a subject in combination with an indoleamine 2,3-dioxygenase (IDO) inhibitor. IDO is an enzyme that catalyzes the degradation of the amino acid, L-tryptophan, to kynurenine. Many cancers overexpress IDO, e.g., prostatic, colorectal, pancreatic, cervical, gastric, ovarian, head, and lung cancer. pDCs, macrophages, and dendritic cells (DCs) can express IDO. Without being bound by theory, it is thought that a decrease in L-tryptophan (e.g., catalyzed by IDO) results in an immunosuppressive milieu by inducing T-cell anergy and apoptosis. Thus, without being bound by theory, it is thought that an IDO inhibitor can enhance the efficacy of a CAR-expressing cell described herein, e.g., by decreasing the suppression or death of a CAR-expressing immune cell. In embodiments, the subject has a solid tumor, e.g., a solid tumor described herein, e.g., prostatic, colorectal, pancreatic, cervical, gastric, ovarian, head, or lung cancer. Exemplary inhibitors of IDO include but are not limited to 1-methyl-tryptophan, indoximod (NewLink Genetics) (see, e.g., Clinical Trial Identifier Nos. NCT01191216; NCT01792050), and INCB024360 (Incyte Corp.) (see, e.g., Clinical Trial Identifier Nos. NCT01604889; NCT01685255)

In embodiments, a CAR-expressing cell described herein is administered to a subject in combination with a modulator of myeloid-derived suppressor cells (MDSCs). MDSCs accumulate in the periphery and at the tumor site of many solid tumors. These cells suppress T cell responses, thereby hindering the efficacy of CAR-expressing cell therapy. Without being bound by theory, it is thought that administration of a MDSC modulator enhances the efficacy of a CAR-expressing cell described herein. In an embodiment, the subject has a solid tumor, e.g., a solid tumor described herein, e.g., glioblastoma. Exemplary modulators of MDSCs include but are not limited to MCS110 and BLZ945. MCS110 is a monoclonal antibody (mAb) against macrophage colony-stimulating factor (M-CSF). See, e.g., Clinical Trial Identifier No. NCT00757757. BLZ945 is a small molecule inhibitor of colony stimulating factor 1 receptor (CSF1R). See, e.g., Pyonteck et al. Nat. Med. 19(2013): 1264-72. The structure of BLZ945 is shown below.

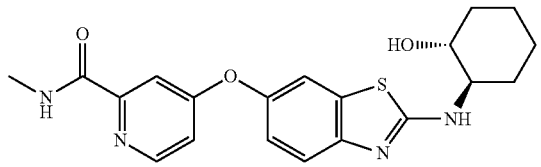 [SMILES: CNC(=O)c1cc(Oc2ccc3nc(N[C@@H]4CCCC[C@H]4O)sc3c2)ccn1]

In embodiments, a CAR-expressing cell described herein is administered to a subject in combination with a CD19 CART cell (e.g., CTL019, e.g., as described in WO2012/079000, incorporated herein by reference). In embodiments, the subject has acute myeloid leukemia (AML), e.g., a CD19 positive AML or a CD19 negative AML. In embodiments, the subject has a CD19+ lymphoma, e.g., a CD19+ Non-Hodgkin's Lymphoma (NHL), a CD19+FL, or a CD19+ DLBCL. In embodiments, the subject has a relapsed or refractory CD19+ lymphoma. In embodiments, a lymphodepleting chemotherapy is administered to the subject prior to, concurrently with, or after administration (e.g., infusion) of CD19 CART cells. In an example, the lymphodepleting chemotherapy is administered to the subject prior to administration of CD19 CART cells. For example, the lymphodepleting chemotherapy ends 1-4 days (e.g., 1, 2, 3, or 4 days) prior to CD19 CART cell infusion. In embodiments, multiple doses of CD19 CART cells are administered, e.g., as described herein. For example, a single dose comprises about $5 \times 10^8$ CD19 CART cells. In embodiments, a lymphodepleting chemotherapy is administered to the subject prior to, concurrently with, or after administration (e.g., infusion) of a CAR-expressing cell described herein, e.g., a non-CD19 CAR-expresing cell. In embodiments, a CD19 CART is administered to the subject prior to, concurrently with, or after administration (e.g., infusion) of a non-CD19 CAR-expressing cell, e.g., a non-CD19 CAR-expressing cell described herein.

In some embodiments, a CAR-expressing cell described herein is administered to a subject in combination with a CD19 CAR-expressing cell, e.g., CTL019, e.g., as described in WO2012/079000, incorporated herein by reference, for treatment of a disease associated with the expression of BCMA, e.g., a cancer described herein. Without being bound by theory, it is believed that administering a CD19 CAR-expressing cell in combination with a CAR-expressing cell improves the efficacy of a CAR-expressing cell described herein by targeting early lineage cancer cells, e.g., cancer stem cells, modulating the immune response, depleting regulatory B cells, and/or improving the tumor microenvironment. For example, a CD19 CAR-expressing cell targets cancer cells that express early lineage markers, e.g., cancer stem cells and CD19-expressing cells, while the CAR-expressing cell described herein targets cancer cells that express later lineage markers, e.g., BCMA. This preconditioning approach can improve the efficacy of the CAR-expressing cell described herein. In such embodiments, the CD19 CAR-expressing cell is administered prior to, concurrently with, or after administration (e.g., infusion) of a CAR-expressing cell described herein.

In embodiments, a CAR-expressing cell described herein also expresses a CAR targeting CD19, e.g., a CD19 CAR. In an embodiment, the cell expressing a CAR described herein and a CD19 CAR is administered to a subject for treatment of a cancer described herein, e.g., AML. In an embodiment, the configurations of one or both of the CAR molecules comprise a primary intracellular signaling domain and a costimulatory signaling domain. In another embodiment, the configurations of one or both of the CAR molecules comprise a primary intracellular signaling domain and two or more, e.g., 2, 3, 4, or 5 or more, costimulatory signaling domains. In such embodiments, the CAR molecule described herein and the CD19 CAR may have the same or a different primary intracellular signaling domain, the same or different costimulatory signaling domains, or the same number or a different number of costimulatory signaling domains. Alternatively, the CAR described herein and the CD19 CAR are configured as a split CAR, in which one of the CAR molecules comprises an antigen binding domain and a costimulatory domain (e.g., 4-1BB), while the other CAR molecule comprises an antigen binding domain and a primary intracellular signaling domain (e.g., CD3 zeta).

In some embodiments, a CAR-expressing cell described herein is administered to a subject in combination with a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15

(Admune Therapeutics, LLC). hetIL-15 is a heterodimeric non-covalent complex of IL-15 and IL-15Ra. hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. In embodiments, het-IL-15 is administered subcutaneously. In embodiments, the subject has a cancer, e.g., solid cancer, e.g., melanoma or colon cancer. In embodiments, the subject has a metastatic cancer.

In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. CRS may include clinical constitutional signs and symptoms such as fever, fatigue, anorexia, myalgias, arthalgias, nausea, vomiting, and headache. CRS may include clinical skin signs and symptoms such as rash. CRS may include clinical gastrointestinal signs and symsptoms such as nausea, vomiting and diarrhea. CRS may include clinical respiratory signs and symptoms such as tachypnea and hypoxemia. CRS may include clinical cardiovascular signs and symptoms such as tachycardia, widened pulse pressure, hypotension, increased cardac output (early) and potentially diminished cardiac output (late). CRS may include clinical coagulation signs and symptoms such as elevated d-dimer, hypofibrinogenemia with or without bleeding. CRS may include clinical renal signs and symptoms such as azotemia. CRS may include clinical hepatic signs and symptoms such as transaminitis and hyperbilirubinemia. CRS may include clinical neurologic signs and symptoms such as headache, mental status changes, confusion, delirium, word finding difficulty or frank aphasia, hallucinations, tremor, dymetria, altered gait, and seizures.

Accordingly, the methods described herein can comprise administering a CAR-expressing cell described herein to a subject and further administering one or more agents to manage elevated levels of a soluble factor resulting from treatment with a CAR-expressing cell. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antibody fragment. Examples of such agents include, but are not limited to a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitors of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In some embodiment, the subject is administered a corticosteroid, such as, e.g., methylprednisolone, hydrocortisone, among others.

In some embodiments, the subject is administered a vasopressor, such as, e.g., norepinephrine, dopamine, phenylephrine, epinephrine, vasopres sin, or a combination thereof.

In an embodiment, the subject can be administered an antipyretic agent. In an embodiment, the subject can be administered an analgesic agent.

In one embodiment, the subject can be administered an agent that prevents trafficking of the BCMA CAR-expressing cell to the brain, e.g., natalizumab (TYSABRI®). BCMA expression, e.g., a splice variant thereof, has been detected in some parts of the brain, e.g., the cerebellum or medulla oblongata. Without being bound by any particular theory, prevention of trafficking of the BCMA CAR-expressing cells to the brain is preferred to prevent any BCMA CAR-expressing cells from interacting with or acting on BCMA-expressing brain tissue.

In one embodiment, the subject can be administered an agent which enhances the activity of a CAR-expressing cell. For example, in one embodiment, the agent can be an agent which inhibits an inhibitory molecule, e.g., the agent is a checkpoint inhibitor. Inhibitory molecules, e.g., Programmed Death 1 (PD1), can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR. In embodiments, a CAR-expressing cell described herein is administered in combination with an inhibitor of an inhibitory molecule, e.g., in combination with a checkpoint inhibitor, e.g., in combination with an inhibitor of PD1 and/or PD-L1. In embodiments, a CAR-expressing cell described herein is administered in combination with an inhibitor of PD1. In embodiments, a CAR-expressing cell described herein is administered in combination with an inhibitor of PD-L1.

In an embodiment, a nucleic acid molecule that encodes a dsRNA molecule that inhibits expression of the molecule that modulates or regulates, e.g., inhibits, T-cell function is operably linked to a promoter, e.g., a H1- or a U6-derived promoter such that the dsRNA molecule that inhibits expression of the molecule that modulates or regulates, e.g., inhibits, T-cell function is expressed, e.g., is expressed within a CAR-expressing cell. See e.g., Tiscornia G., "Development of Lentiviral Vectors Expressing siRNA," Chapter 3, in *Gene Transfer: Delivery and Expression of*

DNA and RNA (eds. Friedmann and Rossi). Cold Spring Harbor Laboratory Press, Cold Spring Harbor, N.Y., USA, 2007; Brummelkamp T R, et al. (2002) Science 296: 550-553; Miyagishi M, et al. (2002) Nat. Biotechnol. 19: 497-500. In an embodiment the nucleic acid molecule that encodes a dsRNA molecule that inhibits expression of the molecule that modulates or regulates, e.g., inhibits, T-cell function is present on the same vector, e.g., a lentiviral vector, that comprises a nucleic acid molecule that encodes a component, e.g., all of the components, of the CAR. In such an embodiment, the nucleic acid molecule that encodes a dsRNA molecule that inhibits expression of the molecule that modulates or regulates, e.g., inhibits, T-cell function is located on the vector, e.g., the lentiviral vector, 5'- or 3'- to the nucleic acid that encodes a component, e.g., all of the components, of the CAR. The nucleic acid molecule that encodes a dsRNA molecule that inhibits expression of the molecule that modulates or regulates, e.g., inhibits, T-cell function can be transcribed in the same or different direction as the nucleic acid that encodes a component, e.g., all of the components, of the CAR. In an embodiment the nucleic acid molecule that encodes a dsRNA molecule that inhibits expression of the molecule that modulates or regulates, e.g., inhibits, T-cell function is present on a vector other than the vector that comprises a nucleic acid molecule that encodes a component, e.g., all of the components, of the CAR. In an embodiment, the nucleic acid molecule that encodes a dsRNA molecule that inhibits expression of the molecule that modulates or regulates, e.g., inhibits, T-cell function it transiently expressed within a CAR-expressing cell. In an embodiment, the nucleic acid molecule that encodes a dsRNA molecule that inhibits expression of the molecule that modulates or regulates, e.g., inhibits, T-cell function is stably integrated into the genome of a CAR-expressing cell. FIGS. 41A-41E depicts examples of vectors for expressing a component, e.g., all of the components, of the CAR with a dsRNA molecule that inhibits expression of the molecule that modulates or regulates, e.g., inhibits, T-cell function.

Examples of dsRNA molecules useful for inhibiting expression of a molecule that modulates or regulates, e.g., inhibits, T-cell function, wherein the molecule that modulates or regulates, e.g., inhibits, T-cell function is PD-1 are provided below.

Provided in Table 13 below are the names of PDCD1 (PD1) RNAi agents (derived from their position in the mouse PDCD1 gene sequence NM_008798.2), along with the SEQ ID NOs: 286-333 representing the DNA sequence. Both sense (S) and antisense (AS) sequences are presented as 19mer and 21mer sequences are in this table. Also note that the position (PoS, e.g., 176) is derived from the position number in the mouse PDCD1 gene sequence NM_008798.2. SEQ ID NOs are indicated in groups of 12 that correspond with "sense 19" SEQ ID NOs: 286-297; "sense 21" SEQ ID NOs: 298-309; "asense 21" SEQ ID NOs: 310-321; "asense 19" SEQ ID NOs: 322-333.

TABLE 13

Mouse PDCD1 (PD1) shRNA sequences

| Position on NM_008798.2 | Target region | Sense19 | Sense21 | Asense21 | Asense19 |
|---|---|---|---|---|---|
| 176 | CDS | GGAGGTCCCT CACCTTCTA (SEQ ID NO: 286) | CTGGAGGTCC CTCACCTTCT A (SEQ ID NO: 298) | TAGAAGGTGA GGGACCTCCA G (SEQ ID NO: 310) | TAGAAGGTGA GGGACCTCC (SEQ ID NO: 322) |
| 260 | CDS | CGGAGGATCT TATGCTGAA (SEQ ID NO: 287) | GTCGGAGGAT CTTATGCTGA A (SEQ ID NO: 299) | TTCAGCATAA GATCCTCCGA C (SEQ ID NO: 311) | TTCAGCATAA GATCCTCCG (SEQ ID NO: 323) |
| 359 | CDS | CCCGCTTCCA GATCATACA (SEQ ID NO: 288) | TGCCCGCTTC CAGATCATAC A (SEQ ID NO: 300) | TGTATGATCT GGAAGCGGGC A (SEQ ID NO: 312) | TGTATGATCT GGAAGCGGG (SEQ ID NO: 324) |
| 528 | CDS | GGAGACCTCA ACAAGATAT (SEQ ID NO: 289) | CTGGAGACCT CAACAAGATA T (SEQ ID NO: 301) | ATATCTTGTT GAGGTCTCCA G (SEQ ID NO: 313) | ATATCTTGTT GAGGTCTCC (SEQ ID NO: 325) |
| 581 | CDS | AAGGCATGGT CATTGGTAT (SEQ ID NO: 290) | TCAAGGCATG GTCATTGGTA T (SEQ ID NO: 302) | ATACCAATGA CCATGCCTTG A (SEQ ID NO: 314) | ATACCAATGA CCATGCCTT (SEQ ID NO: 326) |
| 584 | CDS | GCATGGTCAT TGGTATCAT (SEQ ID NO: 291) | AGGCATGGTC ATTGGTATCA T (SEQ ID NO: 303) | ATGATACCAA TGACCATGCC T (SEQ ID NO: 315) | ATGATACCAA TGACCATGC (SEQ ID NO: 327) |

TABLE 13-continued

Mouse PDCD1 (PD1) shRNA sequences

| Position on NM_008798.2 | Target region | Sense19 | Sense21 | Asense21 | Asense19 |
|---|---|---|---|---|---|
| 588 | CDS | GGTCATTGGT ATCATGAGT (SEQ ID NO: 292) | ATGGTCATTG GTATCATGAG T (SEQ ID NO: 304) | ATGGTCATTG GTATCATGAG T (SEQ ID NO: 316) | ATGGTCATTG GTATCATGA (SEQ ID NO: 328) |
| 609 | CDS | CCTAGTGGGT ATCCCTGTA (SEQ ID NO: 293) | GCCCTAGTGG GTATCCCTGT A (SEQ ID NO: 305) | GCCCTAGTGG GTATCCCTGT A (SEQ ID NO: 317) | GCCCTAGTGG GTATCCCTG (SEQ ID NO: 329) |
| 919 | CDS | GAGGATGGAC ATTGTTCTT (SEQ ID NO: 294) | ATGAGGATGG ACATTGTTCTT (SEQ ID NO: 306) | ATGAGGATGG ACATTGTTCTT (SEQ ID NO: 318) | ATGAGGATGG ACATTGTTC (SEQ ID NO: 330) |
| 1021 | 3'UTR | GCATGCAGGC TACAGTTCA (SEQ ID NO: 295) | GAGCATGCAG GCTACAGTTC A (SEQ ID NO: 307) | GAGCATGCAG GCTACAGTTC A (SEQ ID NO: 319) | GAGCATGCAG GCTACAGTT (SEQ ID NO: 331) |
| 1097 | 3'UTR | CCAGCACATG CACTGTTGA (SEQ ID NO: 296) | TTCCAGCACA TGCACTGTTG A (SEQ ID NO: 308) | TTCCAGCACA TGCACTGTTG A (SEQ ID NO: 320) | TTCCAGCACA TGCACTGTT (SEQ ID NO: 332) |
| 1101 | 3'UTR | CACATGCACT GTTGAGTGA (SEQ ID NO: 297) | AGCACATGCA CTGTTGAGTG A (SEQ ID NO: 309) | AGCACATGCA CTGTTGAGTG A (SEQ ID NO: 321) | AGCACATGCA CTGTTGAGT (SEQ ID NO: 333) |

Provided in Table 14 below are the names of PDCD1 (PD1) RNAi agents (derived from their position in the human PDCD1 gene sequence, along with the SEQ ID NOs. 334-381 representing the DNA sequence. Both sense (S) and antisense (ΔS) sequences are presented as 19mer and 21mer sequences. SEQ ID NOs are indicated in groups of 12 that correspond with "sense 19" SEQ ID NOs: 334-345; "sense 21" SEQ ID NOs: 346-357; "asense 21" SEQ ID NOs: 358-369; "asense 19" SEQ ID NOs: 370-381.

TABLE 14

Human PDCD1 (PD1) shRNA sequences

| Position on NM_005018.2 | Target region | Sense19 | Asense19 | Sense21 | Asense21 |
|---|---|---|---|---|---|
| 145 | CDS | GGCCAGGATG GTTCTTAGA (SEQ ID NO: 334) | TCTAAGAACC ATCCTGGCC (SEQ ID NO: 346) | GCGGCCAGGA TGGTTCTTAG A (SEQ ID NO: 358) | TCTAAGAACC ATCCTGGCCG C (SEQ ID NO: 370) |
| 271 | CDS | GCTTCGTGCT AAACTGGTA (SEQ ID NO: 335) | TACCAGTTTA GCACGAAGC (SEQ ID NO: 347) | GAGCTTCGTG CTAAACTGGT A (SEQ ID NO: 359) | TACCAGTTTA GCACGAAGCT C (SEQ ID NO: 371) |
| 393 | CDS | GGGCGTGACT TCCACATGA (SEQ ID NO: 336) | TCATGTGGAA GTCACGCCC (SEQ ID NO: 348) | ACGGGCGTGA CTTCCACATG A (SEQ ID NO: 360) | TCATGTGGAA GTCACGCCCG T (SEQ ID NO: 372) |

TABLE 14-continued

Human PDCD1 (PD1) shRNA sequences

| Position on NM_005018.2 | Target region | Sense19 | Asense19 | Sense21 | Asense21 |
|---|---|---|---|---|---|
| 1497 | 3'UTR | CAGGCCTAGAGAAGTTTCA (SEQ ID NO: 337) | TGAAACTTCTCTAGGCCTG (SEQ ID NO: 349) | TGCAGGCCTAGAGAAGTTTCA (SEQ ID NO: 361) | TGAAACTTCTCTAGGCCTGCA (SEQ ID NO: 373) |
| 1863 | 3'UTR | CTTGGAACCCATTCCTGAA (SEQ ID NO: 338) | TTCAGGAATGGGTTCCAAG (SEQ ID NO: 350) | TCCTTGGAACCCATTCCTGAA (SEQ ID NO: 362) | TTCAGGAATGGGTTCCAAGGA (SEQ ID NO: 374) |
| 1866 | 3'UTR | GGAACCCATTCCTGAAATT (SEQ ID NO: 339) | AATTTCAGGAATGGGTTCC (SEQ ID NO: 351) | TTGGAACCCATTCCTGAAAT T (SEQ ID NO: 363) | AATTTCAGGAATGGGTTCCA A (SEQ ID NO: 375) |
| 1867 | 3'UTR | GAACCCATTCCTGAAATTA (SEQ ID NO: 340) | TAATTTCAGGAATGGGTTC (SEQ ID NO: 352) | TGGAACCCATTCCTGAAATTA (SEQ ID NO: 364) | TAATTTCAGGAATGGGTTCCA (SEQ ID NO: 376) |
| 1868 | 3'UTR | AACCCATTCCTGAAATTAT (SEQ ID NO: 341) | ATAATTTCAGGAATGGGTT (SEQ ID NO: 353) | GGAACCCATTCCTGAAATTAT (SEQ ID NO: 365) | ATAATTTCAGGAATGGGTTC (SEQ ID NO: 377) |
| 1869 | 3'UTR | ACCCATTCCTGAAATTATT (SEQ ID NO: 342) | AATAATTTCAGGAATGGGT (SEQ ID NO: 354) | GAACCCATTCCTGAAATTATT (SEQ ID NO: 366) | AATAATTTCAGGAATGGGTTC (SEQ ID NO: 378) |
| 1870 | 3'UTR | CCCATTCCTGAAATTATTT (SEQ ID NO: 343) | AAATAATTTCAGGAATGGG (SEQ ID NO: 355) | AACCCATTCCTGAAATTATTT (SEQ ID NO: 367) | AAATAATTTCAGGAATGGGTT (SEQ ID NO: 379) |
| 2079 | 3'UTR | CTGTGGTTCTATTATATTA (SEQ ID NO: 344) | TAATATAATAGAACCACAG (SEQ ID NO: 356) | CCCTGTGGTTCTATTATATTA (SEQ ID NO: 368) | TAATATAATAGAACCACAGG (SEQ ID NO: 380) |
| 2109 | 3'UTR | AAATATGAGAGCATGCTAA (SEQ ID NO: 345) | TTAGCATGCTCTCATATTT (SEQ ID NO: 357) | TTAAATATGAGAGCATGCTAA (SEQ ID NO: 369) | TTAGCATGCTCTCATATTTA (SEQ ID NO: 381) |

In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In embodiments, the agent that enhances the activity of a CAR-expressing cell, e.g., inhibitor of an inhibitory molecule, is administered in combination with an allogeneic CAR, e.g., an allogeneic CAR described herein (e.g., described in the Allogeneic CAR section herein).

PD-1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD-1, PD-L1 and PD-L2 have been shown to downregulate T cell activation upon binding to PD-1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD-1 with PD-L1. Antibodies, antibody fragments, and other inhibitors of PD-1, PD-L1 and PD-L2 are available in the art and may be used combination with a cars of the present invention described herein. For example, nivolumab (also referred to as BMS-936558 or MDX1106; Bristol-Myers Squibb) is a fully human IgG4 monoclonal antibody which specifically blocks PD-1. Nivolumab (clone 5C4) and other human monoclonal antibodies that specifically bind to PD-1 are disclosed in U.S. Pat. No. 8,008,449 and WO2006/121168. Pidilizumab (CT-011; Cure Tech) is a humanized IgG1k monoclonal antibody that binds to PD-1. Pidilizumab and other humanized anti-PD-1 monoclonal antibodies are disclosed in WO2009/101611. Pembrolizumab (formerly known as lambrolizumab, and also referred to as MK03475; Merck) is a humanized IgG4 monoclonal antibody that binds to PD-1. Pembrolizumab and other humanized anti-PD-1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/ Roche) is a human Fc optimized IgG1 monoclonal antibody that binds to PD-L1. MDPL3280A and other human monoclonal antibodies to PD-L1 are disclosed in U.S. Pat. No. 7,943,743 and U.S. Publication No.: 20120039906. Other anti-PD-L1 binding agents include YW243.55.570 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD-1 and B7-H1. Other anti-PD-1 antibodies include AMP 514 (Amplimmune), among others, e.g., anti-PD-1 antibodies disclosed in U.S. Pat. No. 8,609,089, US 2010028330, and/or US 20120114649.

TIM3 (T cell immunoglobulin-3) also negatively regulates T cell function, particularly in IFN-g-secreting CD4+T helper 1 and CD8+T cytotoxic 1 cells, and plays a critical role in T cell exhaustion. Inhibition of the interaction between TIM3 and its ligands, e.g., galectin-9 (Gal9), phosphotidylserine (PS), and HMGB1, can increase immune response. Antibodies, antibody fragments, and other inhibitors of TIM3 and its ligands are available in the art and may be used combination with a CD19 or BCMA CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. *PLoS One.* 2010 Sep. 2; 5(9). pii: e12529 (DOI:10:1371/journal-.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. *J Immunol.* 2002 Mar. 15; 168(6): 2803-10; Markel et al. *J Immunol.* 2006 Nov. 1; 177(9): 6062-71; Markel et al. *Immunology.* 2009 February; 126(2): 186-200; Markel et al. *Cancer Immunol Immunother.* 2010 February; 59(2):215-30; Ortenberg et al. *Mol Cancer Ther.* 2012 June; 11(6):1300-10; Stern et al. *J Immunol.* 2005 Jun. 1; 174(11):6692-701; Zheng et al. *PLoS One.* 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) *Nature* doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CD19 or BCMA CAR described herein. For example, BMS-986016 (Bristol-Myers Squib) is a monoclonal antibody that targets LAG3. IMP701 (Immutep) is an antagonist LAG3 antibody and IMP73 (Immutep and GlaxoSmithKline) is a depleting LAG3 antibody. Other LAW inhibitors include IMP321 (Immutep), which is a recombinant fusion protein of a soluble portion of LAG3 and Ig that binds to MHC class II molecules and activates antigen presenting cells (APC). Other antibodies are disclosed, e.g., in WO2010/019570.

In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comrpsing an antracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell or NK cell that does not express an anti-BCMA CAR.

In one embodiment, the agent which enhances activity of a CAR-expressing cell described herein is miR-17-92.

In one embodiment, the agent which enhances activity of a CAR-described herein is a cytokine. Cytokines have important functions related to T cell expansion, differentiation, survival, and homeostatis. Cytokines that can be administered to the subject receiving a CAR-expressing cell described herein include: IL-2, IL-4, IL-7, IL-9, IL-15, IL-18, and IL-21, or a combination thereof. In preferred embodiments, the cytokine administered is IL-7, IL-15, or IL-21, or a combination thereof. The cytokine can be administered once a day or more than once a day, e.g., twice a day, three times a day, or four times a day. The cytokine can be administered for more than one day, e.g. the cytokine is administered for 2 days, 3 days, 4 days, 5 days, 6 days, 1 week, 2 weeks, 3 weeks, or 4 weeks. For example, the cytokine is administered once a day for 7 days.

In embodiments, the cytokine is administered in combination with CAR-expressing T cells. The cytokine can be administered simultaneously or concurrently with the CAR-expressing T cells, e.g., administered on the same day. The cytokine may be prepared in the same pharmaceutical composition as the CAR-expressing T cells, or may be prepared in a separate pharmaceutical composition. Alternatively, the cytokine can be administered shortly after administration of the CAR-expressing T cells, e.g., 1 day, 2 days, 3 days, 4 days, 5 days, 6 days, or 7 days after administration of the CAR-expressing T cells. In embodiments where the cytokine is administered in a dosing regimen that occurs over more than one day, the first day of the cytokine dosing regimen can be on the same day as administration with the CAR-expressing T cells, or the first day of the cytokine dosing regimen can be 1 day, 2 days, 3 days, 4 days, 5 days, 6 days, or 7 days after administration of the CAR-expressing T cells. In one embodiment, on the first day, the CAR-expressing T cells are administered to the subject, and on the second day, a cytokine is administered once a day for the next 7 days. In a preferred embodiment, the cytokine to be administered in combination with CAR-expressing T cells is IL-7, IL-15, or IL-21.

In other embodiments, the cytokine is administered a period of time after administration of CAR-expressing cells, e.g., at least 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells. In one embodiment, the cytokine is administered after assessment of the subject's response to the CAR-expressing cells. For example, the subject is administered CAR-expressing cells according to the dosage and regimens described herein. The response of the subject to CAR-expressing cell therapy is assessed at 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells, using any of the methods described herein, including inhibition of tumor growth, reduction of circulating tumor cells, or tumor regression. Subjects that do not exhibit a sufficient response to CAR-expressing cell therapy can be administered a cytokine. Administration of the cytokine to the subject that has sub-optimal response to the CAR-expressing cell therapy improves CAR-expressing cell efficacy or anti-cancer activity. In a preferred embodiment, the cytokine administered after administration of CAR-expressing cells is IL-7.

Combination with a Low, Immune Enhancing, Dose of an mTOR Inhibitor

Methods described herein use low, immune enhancing, doses of mTOR inhibitors, e.g., allosteric mTOR inhibitors, including rapalogs such as RAD001. Administration of a low, immune enhancing, dose of an mTOR inhibitor (e.g., a dose that is insufficient to completely suppress the immune system, but sufficient to improve immune function) can optimize the performance of immune effector cells, e.g., T cells or CAR-expressing cells, in the subject. Methods for measuring mTOR inhibition, dosages, treatment regimens, and suitable pharmaceutical compositions are described in U.S. Patent Application No. 2015/01240036, hereby incorporated by reference.

In an embodiment, administration of a low, immune enhancing, dose of an mTOR inhibitor results in one or more of the following:
  i) a decrease in the number of PD-1 positive immune effector cells;
  ii) an increase in the number of PD-1 negative immune effector cells;
  iii) an increase in the ratio of PD-1 negative immune effector cells/PD-1 positive immune effector cells;
  iv) an increase in the number of naive T cells;
  v) an increase in the expression of one or more of the following markers: $CD62L^{high}$, $CD127^{high}$, $CD27^+$, and BCL2, e.g., on memory T cells, e.g., memory T cell precursors;
  vi) a decrease in the expression of KLRG1, e.g., on memory T cells, e.g., memory T cell precursors; or
  vii) an increase in the number of memory T cell precursors, e.g., cells with any one or combination of the following characteristics: increased $CD62L^{high}$, increased $CD127^{high}$, increased $CD27^+$, decreased KLRG1, and increased BCL2;
and wherein any of the foregoing, e.g., i), ii), iii), iv), v), vi), or vii), occurs e.g., at least transiently, e.g., as compared to a non-treated subject.

In another embodiment, administration of a low, immune enhancing, dose of an mTOR inhibitor results in increased or prolonged proliferation or persistence of CAR-expressing cells, e.g., in culture or in a subject, e.g., as compared to non-treated CAR-expressing cells or a non-treated subject. In embodiments, increased proliferation or persistence is associated with in an increase in the number of CAR-expressing cells. Methods for measuring increased or prolonged proliferation are described in Examples 15 and 16. In another embodiment, administration of a low, immune enhancing, dose of an mTOR inhibitor results in increased killing of cancer cells by CAR-expressing cells, e.g., in culture or in a subject, e.g., as compared to non-treated CAR-expressing cells or a non-treated subject. In embodiments, increased killing of cancer cells is associated with in a decrease in tumor volume. Methods for measuring increased killing of cancer cells are described herein, e.g., in Examples 2, 5-6, 8, and 13. In one embodiment, the cells expressing a CAR molecule, e.g., a CAR molecule described herein, are administered in combination with a low, immune enhancing dose of an mTOR inhibitor, e.g., an allosteric mTOR inhibitor, e.g., RAD001, or a catalytic mTOR inhibitor. For example, administration of the low, immune enhancing, dose of the mTOR inhibitor can be initiated prior to administration of a CAR-expressing cell described herein; completed prior to administration of a CAR-expressing cell described herein; initiated at the same time as administration of a CAR-expressing cell described herein; overlapping with administration of a CAR-expressing cell described herein; or continuing after administration of a CAR-expressing cell described herein.

Alternatively or in addition, administration of a low, immune enhancing, dose of an mTOR inhibitor can optimize immune effector cells to be engineered to express a CAR molecule described herein. In such embodiments, administration of a low, immune enhancing, dose of an mTOR inhibitor, e.g., an allosteric inhibitor, e.g., RAD001, or a catalytic inhibitor, is initiated or completed prior to harvest of immune effector cells, e.g., T cells or NK cells, to be engineered to express a CAR molecule described herein, from a subject.

In another embodiment, immune effector cells, e.g., T cells or NK cells, to be engineered to express a CAR molecule described herein, e.g., after harvest from a subject, or CAR-expressing immune effector cells, e.g., T cells or NK cells, e.g., prior to administration to a subject, can be cultured in the presence of a low, immune enhancing, dose of an mTOR inhibitor.

In an embodiment, administering to the subject a low, immune enhancing, dose of an mTOR inhibitor comprises administering, e.g., once per week, e.g., in an immediate release dosage form, 0.1 to 20, 0.5 to 10, 2.5 to 7.5, 3 to 6, or about 5, mgs of RAD001, or a bioequivalent dose thereof. In an embodiment, administering to the subject a low, immune enhancing, dose of an mTOR inhibitor comprises administering, e.g., once per week, e.g., in a sustained release dosage form, 0.3 to 60, 1.5 to 30, 7.5 to 22.5, 9 to 18, or about 15 mgs of RAD001, or a bioequivalent dose thereof.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, at least 70 but no more than 90%, at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, at least 60 but no more than 80%, at least 5 but no more than 70%, at least 10 but no more than 70%, at least 15, but no more than 70%, at least 20 but no more than 70%, at least 30 but no more than 70%, at least 40 but no more than 70%, at least 50 but no more than 70%, at least 5 but no more than 60%, at least 10 but no more than 60%, at least 15, but no more than 60%, at least 20 but no more than 60%, at least 30 but no more than 60%, at least 40 but no more than 60%, at least 5 but no more than 50%, at least 10 but no more than 50%, at least 15, but no more than 50%, at least 20 but no more than 50%, at least 30 but no more than 50%, at least 40 but no more than 50%, at least 5 but no more than 40%, at least 10 but no more than 40%, at least 15, but no more than 40%, at least 20 but no more than 40%, at least 30 but no more than 40%, at least 35 but no more than 40%, at least 5 but no more than 30%, at least 10 but no more than 30%, at least 15, but no more than 30%, at least 20 but no more than 30%, or at least 25 but no more than 30%.

In an embodiment, administering to the subject a low, immune enhancing, dose of an mTOR inhibitor comprises administering, e.g., once per week, e.g., in an immediate release dosage form, 0.1 to 20, 0.5 to 10, 2.5 to 7.5, 3 to 6, or about 5, mgs of RAD001, or a bioequivalent dose thereof. In an embodiment, administering to the subject a low, immune enhancing, dose of an mTOR inhibitor comprises administering, e.g., once per week, e.g., in a sustained release dosage form, 0.3 to 60, 1.5 to 30, 7.5 to 22.5, 9 to 18, or about 15 mgs of RAD001, or a bioequivalent dose thereof.

The extent of mTOR inhibition can be conveyed as, or corresponds to, the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by various methods, such as measuring P70 S6 kinase activity by the Boulay assay, as described in U.S. Patent Application No. 2015/01240036, hereby incorporated by reference, or as described in U.S. Pat. No. 7,727,950, hereby incorporated by reference; measuring the level of phosphorylated S6 by western blot; or evaluating a change in the ratio of PD1 negative immune effector cells to PD1 positive immune effector cells.

As used herein, the term "mTOR inhibitor" refers to a compound or ligand, or a pharmaceutically acceptable salt thereof, which inhibits the mTOR kinase in a cell. In an embodiment, an mTOR inhibitor is an allosteric inhibitor. Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity. In an embodiment, an mTOR inhibitor is a catalytic inhibitor.

Rapamycin is a known macrolide antibiotic produced by *Streptomyces hygroscopicus* having the structure shown in Formula A.

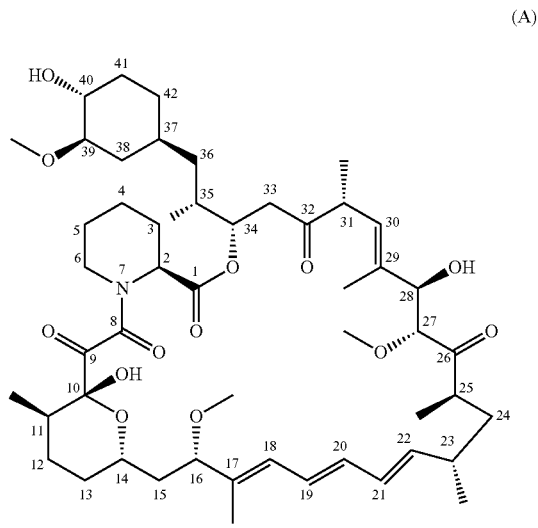 [SMILES: CO[C@H]1C[C@@H]2CC[C@@H](C)[C@@](O)(O2)C(=O)C(=O)N2CCCC[C@H]2C(=O)O[C@H]([C@H](C)C[C@@H]2CC[C@@H](O)[C@H](OC)C2)CC(=O)[C@H](C)/C=C(\C)[C@@H](O)[C@@H](OC)C(=O)[C@H](C)C[C@H](C)/C=C/C=C/C=C/1C]

(A)

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, O-substituted analogs in which the hydroxyl group on the cyclohexyl ring of rapamycin is replaced by $OR_1$ in which $R_1$ is hydroxyalkyl, hydroxyalkoxyalkyl, acylaminoalkyl, or aminoalkyl; e.g. RAD001, also known as everolimus, as described in U.S. Pat. No. 5,665,772 and WO94/09010, the contents of each are incorporated by reference.

Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E, 4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2-acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2-aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethyl)-rapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. RE44,768, e.g. temsirolimus.

Other rapamycin analogs useful in the preset invention include those wherein the methoxy group at the 16 position is replaced with another substituent, preferably (optionally hydroxy-substituted) alkynyloxy, benzyl, orthomethoxybenzyl or chlorobenzyl and/or wherein the mexthoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807, the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demthoxy-16-(pent-2-ynyl)oxy-rapamycin, 16-demthoxy-16-(but-2-ynyl)oxy-rapamycin, 16-demthoxy-16-(propargyl)oxy-rapamycin, 16-demethoxy-16-(4-hydroxy-but-2-ynyl)oxy-rapamycin, 16-demthoxy-16-benzyloxy-40-O-(2-hydroxyethyl)-rapamycin, 16-demthoxy-16-benzyloxy-rapamycin, 16-demethoxy-16-ortho-methoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methyl-piperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl, N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (Afinitor®), has the chemical name (1R,9S,12S,15R,16E,18R,19R,21R,23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone, as described in U.S. Pat. No. 5,665,772 and WO94/09010, the contents of each are incorporated by reference.

Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibtors include zotarolimus (AB T578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]quinolin-1-yl)-phenyl]-propionitrile, or the monotosylate salt form (the synthesis of BEZ235 is described in WO2006/122806); CCG168 (otherwise known as AZD-8055, Chresta, C. M., et al., Cancer Res, 2010, 70(1), 288-298) which has the chemical name {5-[2,4-bis-((S)-3-methyl-morpholin-4-yl)-pyrido[2,3d]pyrimidin-7-yl]-2-methoxy-phenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl)sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl}benzenesulfonamide; 5-(9-isopropyl-8-methyl-2-morpholino-9H-purin-6-yl)pyrimidin-2-amine (WO10114484); and (E)-N-(8-(6-amino-5-(trifluoromethyl)pyridin-3-yl)-1-(6-(2-cyanopropan-2-yl)pyridin-3-yl)-3-methyl-1H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTOR inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing.

mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Methods and Biomarkers for Evaluating CAR-Effectiveness or Sample Suitability

In another aspect, the invention features a method of evaluating or monitoring the effectiveness of a CAR-expressing cell therapy (e.g., a BCMACAR therapy), in a subject (e.g., a subject having a cancer, e.g., a hematological cancer), or the suitability of a sample (e.g., an apheresis sample) for a CAR therapy (e.g., a BCMACAR therapy). The method includes acquiring a value of effectiveness to the CAR therapy, or sample suitability, wherein said value is indicative of the effectiveness or suitability of the CAR-expressing cell therapy.

In embodiments, the value of effectiveness to the CAR therapy, or sample suitability, comprises a measure of one, two, three, four, five, six or more (all) of the following:

(i) the level or activity of one, two, three, or more (e.g., all) of resting $T_{EFF}$ cells, resting $T_{REG}$ cells, younger T cells (e.g., younger CD4 or CD8 cells, or gamma/delta T cells), or early memory T cells, or a combination thereof, in a sample (e.g., an apheresis sample or a manufactured CAR-expressing cell product sample);

(ii) the level or activity of one, two, three, or more (e.g., all) of activated $T_{EFF}$ cells, activated $T_{REG}$ cells, older T cells (e.g., older CD4 or CD8 cells), or late memory T cells, or a combination thereof, in a sample (e.g., an apheresis sample or a manufactured CAR-expressing cell product sample);

(iii) the level or activity of an immune cell exhaustion marker, e.g., one, two or more immune checkpoint inhibitors (e.g., PD-1, PD-L1, TIM-3 and/or LAG-3) in a sample (e.g., an apheresis sample or a manufactured CAR-expressing cell product sample). In one embodiment, an immune cell has an exhausted phenotype, e.g., co-expresses at least two exhaustion markers, e.g., co-expresses PD-1 and TIM-3. In other embodiments, an immune cell has an exhausted phenotype, e.g., co-expresses at least two exhaustion markers, e.g., co-expresses PD-1 and LAG-3;

(iv) the level or activity of CD27 and/or CD45RO− (e.g., CD27+CD45RO−) immune effector cells, e.g., in a CD4+ or a CD8+ T cell population, in a sample (e.g., an apheresis sample or a manufactured CAR-expressing cell product sample);

(v) the level or activity of one, two, three, four, five, ten, twenty or more of the biomarkers chosen from CCL20, IL-17a and/or IL-6, PD-1, PD-L1, LAG-3, TIM-3, CD57, CD27, CD122, CD62L, KLRG1;

(vi) a cytokine level or activity (e.g., quality of cytokine reportoire) in a CAR-expressing cell product sample, e.g., BCMA-expressing cell product sample; or (vii) a transduction efficiency of a CAR-expressing cell in a manufactured CAR-expressing cell product sample.

In some embodiments of any of the methods disclosed herein, the CAR-expressing cell therapy comprises a plurality (e.g., a population) of CAR-expressing immune effector cells, e.g., a plurality (e.g., a population) of T cells or NK cells, or a combination thereof. In one embodiment, the CAR-expressing cell therapy is a BCMACAR therapy.

In some embodiments of any of the methods disclosed herein, the measure of one or more of (i)-(vii) is obtained from an apheresis sample acquired from the subject. The apheresis sample can be evaluated prior to infusion or re-infusion.

In some embodiments of any of the methods disclosed herein, the measure of one or more of (i)-(vii) is obtained from a manufactured CAR-expressing cell product sample, e.g., BCMACAR-expressing cell product sample. The manufactured CAR-expressing cell product can be evaluated prior to infusion or re-infusion.

In some embodiments of any of the methods disclosed herein, the subject is evaluated prior to receiving, during, or after receiving, the CAR-expressing cell therapy.

In some embodiments of any of the methods disclosed herein, the measure of one or more of (i)-(vii) evaluates a profile for one or more of gene expression, flow cytometry or protein expression.

In some embodiments of any of the methods disclosed herein, the method further comprises identifying the subject as a responder, a non-responder, a relapser or a non-relapser, based on a measure of one or more of (i)-(vii).

In some embodiments of any of the methods disclosed herein, a responder (e.g., a complete responder) has, or is identified as having, a greater level or activity of one, two, or more (all) of GZMK, PPF1BP2, or naïve T cells as compared to a non-responder.

In some embodiments of any of the methods disclosed herein, a non-responder has, or is identified as having, a greater level or activity of one, two, three, four, five, six, seven, or more (e.g., all) of IL22, IL-2RA, IL-21, IRF8, IL8, CCL17, CCL22, effector T cells, or regulatory T cells, as compared to a responder.

In an embodiment, a relapser is a patient having, or who is identified as having, an increased level of expression of one or more of (e.g., 2, 3, 4, or all of) the following genes, compared to non relapsers: MIR199A1, MIR1203, uc021ovp, ITM2C, and HLA-DQB1 and/or a decreased levels of expression of one or more of (e.g., 2, 3, 4, 5, 6, 7, 8, 9, 10, 11, or all of) the following genes, compared to non relapsers: PPIAL4D, TTTY10, TXLNG2P, MIR4650-1, KDM5D, USP9Y, PRKY, RPS4Y2, RPS4Y1, NCRNA00185, SULT1E1, and EIF1AY.

In some embodiments of any of the methods disclosed herein, a complete responder has, or is identified as having, a greater, e.g., a statistically significant greater, percentage of CD8+ T cells compared to a reference value, e.g., a non-responder percentage of CD8+ T cells.

In some embodiments of any of the methods disclosed herein, a complete responder has, or is identified as having, a greater percentage of CD27+CD45RO− immune effector cells, e.g., in the CD8+ population, compared to a reference value, e.g., a non-responder number of CD27+CD45RO− immune effector cells.

In some embodiments of any of the methods disclosed herein, a complete responder or a partial responder has, or is identified as having, a greater, e.g., a statistically significant greater, percentage of CD4+ T cells compared to a reference value, e.g., a non-responder percentage of CD4+ T cells.

In some embodiments of any of the methods disclosed herein, a complete responder has, or is identified as having, a greater percentage of one, two, three, or more (e.g., all) of resting $T_{EFF}$ cells, resting $T_{REG}$ cells, younger T cells (e.g., younger CD4 or CD8 cells, or gamma/delta T cells), or early memory T cells, or a combination thereof, compared to a reference value, e.g., a non-responder number of resting $T_{EFF}$ cells, resting $T_{REG}$ cells, younger T cells (e.g., younger CD4 or CD8 cells), or early memory T cells.

In some embodiments of any of the methods disclosed herein, a non-responder has, or is identified as having, a greater percentage of one, two, three, or more (e.g., all) of activated $T_{EFF}$ cells, activated $T_{REG}$ cells, older T cells (e.g., older CD4 or CD8 cells), or late memory T cells, or a combination thereof, compared to a reference value, e.g., a responder number of activated $T_{EFF}$ cells, activated $T_{REG}$ cells, older T cells (e.g., older CD4 or CD8 cells), or late memory T cells.

In some embodiments of any of the methods disclosed herein, a non-responder has, or is identified as having, a greater percentage of an immune cell exhaustion marker, e.g., one, two or more immune checkpoint inhibitors (e.g., PD-1, PD-L1, TIM-3 and/or LAG-3). In one embodiment, a non-responder has, or is identified as having, a greater percentage of PD-1, PD-L1, or LAG-3 expressing immune effector cells (e.g., CD4+ T cells and/or CD8+ T cells) (e.g., CAR-expressing CD4+ cells and/or CD8+ T cells) compared to the percentage of PD-1 or LAG-3 expressing immune effector cells from a responder.

In one embodiment, a non-responder has, or is identified as having, a greater percentage of immune cells having an exhausted phenotype, e.g., immune cells that co-express at least two exhaustion markers, e.g., co-expresses PD-1, PD-L1 and/or TIM-3. In other embodiments, a non-responder has, or is identified as having, a greater percentage of immune cells having an exhausted phenotype, e.g., immune cells that co-express at least two exhaustion markers, e.g., co-expresses PD-1 and LAG-3.

In some embodiments of any of the methods disclosed herein, a non-responder has, or is identified as having, a greater percentage of PD-1/PD-L1+/LAG-3+ cells in the CAR-expressing cell population (e.g., a BCMACAR+ cell population) compared to a responder (e.g., a complete responder) to the CAR-expressing cell therapy.

In some embodiments of any of the methods disclosed herein, a partial responder has, or is identified as having, a higher percentages of PD-1/PD-L1+/LAG-3+ cells, than a responder, in the CAR-expressing cell population (e.g., a BCMACAR+ cell population).

In some embodiments of any of the methods disclosed herein, a non-responder has, or is identified as having, an exhausted phenotype of PD1/PD-L1+ CAR+ and co-expression of LAG3 in the CAR-expressing cell population (e.g., a BCMACAR+ cell population).

In some embodiments of any of the methods disclosed herein, a non-responder has, or is identified as having, a greater percentage of PD-1/PD-L1+/TIM-3+ cells in the CAR-expressing cell population (e.g., a BCMACAR+ cell population) compared to the responder (e.g., a complete responder).

In some embodiments of any of the methods disclosed herein, a partial responders has, or is identified as having, a higher percentage of PD-1/PD-L1+/TIM-3+ cells, than responders, in the CAR-expressing cell population (e.g., a BCMACAR+ cell population).

In some embodiments of any of the methods disclosed herein, the presence of CD8+CD27+CD45RO− T cells in an apheresis sample is a positive predictor of the subject response to a CAR-expressing cell therapy (e.g., a BCMACAR therapy).

In some embodiments of any of the methods disclosed herein, a high percentage of PD1+ CAR+ and LAG3+ or TIM3+ T cells in an apheresis sample is a poor prognostic predictor of the subject response to a CAR-expressing cell therapy (e.g., a BCMACAR therapy).

In some embodiments of any of the methods disclosed herein, the responder (e.g., the complete or partial responder) has one, two, three or more (or all) of the following profile:

(i) has a greater number of CD27+ immune effector cells compared to a reference value, e.g., a non-responder number of CD27+ immune effector cells;

(ii) (i) has a greater number of CD8+ T cells compared to a reference value, e.g., a non-responder number of CD8+ T cells;

(iii) has a lower number of immune cells expressing one or more checkpoint inhibitors, e.g., a checkpoint inhibitor chosen from PD-1, PD-L1, LAG-3, TIM-3, or KLRG-1, or a combination, compared to a reference value, e.g., a non-responder number of cells expressing one or more checkpoint inhibitors; or (iv) has a greater number of one, two, three, four or more (all) of resting $T_{EFF}$ cells, resting $T_{REG}$ cells, naïve CD4 cells, unstimulated memory cells or early memory T cells, or a combination thereof, compared to a reference value, e.g., a non-responder number of resting $T_{EFF}$ cells, resting $T_{REG}$ cells, naïve CD4 cells, unstimulated memory cells or early memory T cells.

In some embodiments of any of the methods disclosed herein, the cytokine level or activity of (vi) is chosen from one, two, three, four, five, six, seven, eight, or more (or all) of cytokine CCL20/MIP3a, IL17A, IL6, GM-CSF, IFNγ, IL10, IL13, IL2, IL21, IL4, IL5, IL9 or TNFα, or a combination thereof. The cytokine can be chosen from one, two, three, four or more (all) of IL-17a, CCL20, IL2, IL6, or TNFα. In one embodiment, an increased level or activity of a cytokine is chosen from one or both of IL-17a and CCL20, is indicative of increased responsiveness or decreased relapse.

In some embodiments of any of the methods disclosed herein, a transduction efficiency of 15% or higher in (vii) is indicative of increased responsiveness or decreased relapse.

In some embodiments of any of the methods disclosed herein, a transduction efficiency of less than 15% in (vii) is indicative of decreased responsiveness or increased relapse.

In embodiments, the responder, a non-responder, a relapser or a non-relapser identified by the methods herein can be further evaluated according to clinical criteria. For example, a complete responder has, or is identified as, a subject having a disease, e.g., a cancer, who exhibits a complete response, e.g., a complete remission, to a treatment. A complete response may be identified, e.g., using the NCCN Guidelines®, or Cheson et al, J Clin Oncol 17:1244 (1999) and Cheson et al., "Revised Response Criteria for Malignant Lymphoma", J Clin Oncol 25:579-586 (2007) (both of which are incorporated by reference herein in their entireties), as described herein. A partial responder has, or is identified as, a subject having a disease, e.g., a cancer, who exhibits a partial response, e.g., a partial remission, to a treatment. A partial response may be identified, e.g., using the NCCN Guidelines®, or Cheson criteria as described herein. A non-responder has, or is identified as, a subject having a disease, e.g., a cancer, who does not exhibit a response to a treatment, e.g., the patient has stable disease or progressive disease. A non-responder may be identified, e.g., using the NCCN Guidelines®, or Cheson criteria as described herein.

Alternatively, or in combination with the methods disclosed herein, responsive to said value, performing one, two, three four or more of:

administering e.g., to a responder or a non-relapser, a CAR-expressing cell therapy;

administered an altered dosing of a CAR-expressing cell therapy;

altering the schedule or time course of a CAR-expressing cell therapy;

administering, e.g., to a non-responder or a partial responder, an additional agent in combination with a CAR-expressing cell therapy, e.g., a checkpoint inhibitor, e.g., a checkpoint inhibitor described herein;

administering to a non-responder or partial responder a therapy that increases the number of younger T cells in the subject prior to treatment with a CAR-expressing cell therapy;

modifying a manufacturing process of a CAR-expressing cell therapy, e.g., enriching for younger T cells prior to introducing a nucleic acid encoding a CAR, or increasing the transduction efficiency, e.g., for a subject identified as a non-responder or a partial responder;

administering an alternative therapy, e.g., for a non-responder or partial responder or relapser; or if the subject is, or is identified as, a non-responder or a relapser, decreasing the $T_{REG}$ cell population and/or $T_{REG}$ gene signature, e.g., by one or more of CD25 depletion, administration of cyclophosphamide, anti-GITR antibody, or a combination thereof.

In certain embodiments, the subject is pre-treated with an anti-GITR antibody. In certain embodiment, the subject is treated with an anti-GITR antibody prior to infusion or re-infusion.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic.

Examples of suitable biopolymers include, but are not limited to, agar, agarose, alginate, alginate/calcium phosphate cement (CPC), beta-galactosidase (β-GAL), (1,2,3,4, 6-pentaacetyl a-D-galactose), cellulose, chitin, chitosan, collagen, elastin, gelatin, hyaluronic acid collagen, hydroxyapatite, poly(3-hydroxybutyrate-co-3-hydroxyhexanoate) (PHBHHx), poly(lactide), poly(caprolactone) (PCL), poly(lactide-co-glycolide) (PLG), polyethylene oxide (PEO), poly(lactic-co-glycolic acid) (PLGA), polypropylene oxide (PPO), polyvinyl alcohol) (PVA), silk, soy protein, and soy protein isolate, alone or in combination with any other polymer composition, in any concentration and in any ratio. The biopolymer can be augmented or modified with adhesion- or migration-promoting molecules, e.g., collagen-mimetic peptides that bind to the collagen receptor of lymphocytes, and/or stimulatory molecules to enhance the delivery, expansion, or function, e.g., anti-cancer activity, of the cells to be delivered. The biopolymer scaffold can be an injectable, e.g., a gel or a semi-solid, or a solid composition.

In some embodiments, CAR-expressing cells described herein are seeded onto the biopolymer scaffold prior to delivery to the subject. In embodiments, the biopolymer scaffold further comprises one or more additional therapeutic agents described herein (e.g., another CAR-expressing cell, an antibody, or a small molecule) or agents that enhance the activity of a CAR-expressing cell, e.g., incorporated or conjugated to the biopolymers of the scaffold. In embodiments, the biopolymer scaffold is injected, e.g., intratumorally, or surgically implanted at the tumor or within a proximity of the tumor sufficient to mediate an anti-tumor effect. Additional examples of biopolymer compositions and methods for their delivery are described in Stephan et al., *Nature Biotechnology*, 2015, 33:97-101; and WO2014/110591.

Pharmaceutical Compositions and Treatments

Pharmaceutical compositions of the present invention may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated T cells to a subject and then subsequently redraw blood (or have an apheresis performed), activate T cells therefrom according to the present invention, and reinfuse the patient with these activated and expanded T cells. This process can be carried out multiple times every few weeks. In certain aspects, T cells can be activated from blood draws of from 10 cc to 400 cc. In certain aspects, T cells are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions of the present invention are administered to a patient by intradermal or subcutaneous injection. In one aspect, the CAR-expressing cell (e.g., T cell or NK cell) compositions of the present invention are administered by i.v. injection. The compositions of CAR-expressing cells (e.g., T cells or NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., immune effector cells (e.g., T cells or NK cells). These immune effector cell (e.g., T cell or NK cell) isolates may be expanded by methods known in the art and treated such that one or more CAR constructs of the invention may be introduced, thereby creating a CAR-expressing cell (e.g., CAR T cell or CAR-expressing NK cell) of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR-expressing cells (e.g., CAR T cells or NK cells) of the present invention. In an additional aspect, expanded cells are administered before or following surgery.

In embodiments, lymphodepletion is performed on a subject, e.g., prior to administering one or more cells that express a CAR described herein, e.g., a BCMA-binding CAR described herein. In embodiments, the lymphodepletion comprises administering one or more of melphalan, cytoxan, cyclophosphamide, and fludarabine.

The dosage of the above treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described in U.S. Pat. No. 6,120,766).

In one embodiment, the CAR is introduced into immune effector cells (e.g., T cells or NK cells), e.g., using in vitro transcription, and the subject (e.g., human) receives an initial administration of CAR immune effector cells (e.g., T cells or NK cells) of the invention, and one or more subsequent administrations of the CAR immune effector cells (e.g., T cells or NK cells) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR immune effector cells (e.g., T cells or NK cells) of the invention are administered to the subject (e.g., human) per week, e.g., 2, 3, or 4 administrations of the CAR immune effector cells (e.g., T cells or NK cells) of the invention are administered per week. In one embodiment, the subject (e.g., human subject) receives more than one administration of the CAR immune effector cells (e.g., T cells or NK cells) per week (e.g., 2, 3 or 4 administrations per week) (also referred to herein as a cycle), followed by a week of no CAR immune effector cells (e.g., T cells or NK cells) administrations, and then one or more additional administration of the CAR immune effector cells (e.g., T cells or NK cells) (e.g., more than one administration of the CAR immune effector cells (e.g., T cells or NK cells) per week) is administered to the subject. In another embodiment, the subject (e.g., human subject) receives more than one cycle of CAR immune effector cells (e.g., T cells or NK cells), and the time between each cycle is less than 10, 9, 8, 7, 6, 5, 4, or 3 days. In one embodiment, the CAR immune effector cells (e.g., T cells or NK cells) are administered every other day for 3 administrations per week. In one embodiment, the CAR immune effector cells (e.g., T cells or NK cells) of the invention are administered for at least two, three, four, five, six, seven, eight or more weeks.

In one aspect, BCMA CAR-expressing cells (e.g., BCMA CARTs or BCMA CAR-expressing NK cells) are generated using lentiviral viral vectors, such as lentivirus. CAR-expressing cells (e.g., CARTs or CAR-expressing NK cells) generated that way will have stable CAR expression.

In one aspect, CAR-expressing cells, e.g., CARTs, are generated using a viral vector such as a gammaretroviral vector, e.g., a gammaretroviral vector described herein. CARTs generated using these vectors can have stable CAR expression.

In one aspect, CAR-expressing cells (e.g., CARTs or CAR-expressing NK cells) transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell, e.g., T cell or NK cell, by electroporation.

A potential issue that can arise in patients being treated using transiently expressing CAR-expressing cells (e.g., CARTs or CAR-expressing NK cells) (particularly with murine scFv bearing CAR-expressing cells (e.g., CARTs or CAR-expressing NK cells)) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CAR-expressing cell (e.g., CART or CAR-expressing NK cell) infusion breaks should not last more than ten to fourteen days.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples specifically point out various aspects of the present invention, and are not to be construed as limiting in any way the remainder of the disclosure.

Example 1: BCMA is Expressed in Myeloma Cell Lines and Primary Samples

Analysis of BCMA Expression in Myeloma Cell Lines by Quantitative PCR 16 cell lines of human cancers were screened for BCMA RNA expression by quantitative RT-PCR. RNA was extracted with RNAqueos-4PCR Kit (Ambion, AM-1914) and cDNA was synthesized with iScript Reverse Transcription Supermix for RT-qPCR (BioRad, 170-8841). The relative BCMA cDNA copies were quantified by relative qPCR (qPCR) with ABI TaqMan BCMA-specific primers and probe set (ABI, Hs03045080, lot:1139777); TaqMan GUSB (ABI, Hs99999908_M1, lot: 1093869) primers and probe set for normalization.

Analysis of the qPCR showed that all MM cell lines (U266, NCI H929 and RPMI 8226) tested express BCMA. BCMA was also detected in BJAB and LCL cells (B-cell lymphoblastoid cell lines) and CEM cells (a T-lymphoblastoid cell line). None of the other non-MM cell lines exhibited detectable expression of BCMA. This RNA analysis compliments protein detection by flow cytometry for the selection of positive BCMA expressing cell lines used in evaluations. Detailed results are provided in FIG. 1A.

Figure 1B:
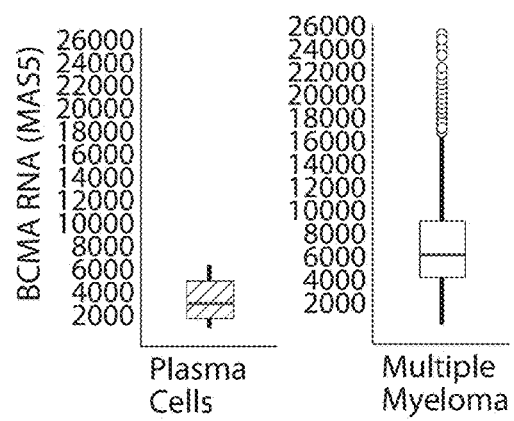

Comparison by RNA analysis of BCMA expression in plasma cells and in the different multiple myeloma samples from patients is provided in FIG. 1B.

Analysis of BCMA Expression in Multiple Myeloma Cells Lines and Primary Samples by Flow Cytometry Multiple Myeloma (MM) cell lines U266, NCI H929 or RPMI 8226 or primary samples from MM patients (PB or BM) were stained with Human BCMA/TNFRSF17 Phycoerythrin Affinity Purified PAb, Goat IgG (R&D, FAB193P). Primary samples from multiple myeloma patients were also stained with Live/dead dye (LifeTechnologies, L34960), CD45-BV421 (Biolegend, 304032), CD38-APCeF780 (eBioscience 47-0389-42), CD138-APC (eBioscience 17-1389-42), CD19-PECY7 (eBioscience, E10328-1632), lambda chain-PerCP-eF710 (eBioscience 46-9990-42) and Kappa light chain (eBioscience, 11-9970-42). Data from staoined samplse were collected using a BD Fortessa cytometer. Flow cytometric analysis performed using Flowjo v10 (Tree Star Inc).

Figure 2A:
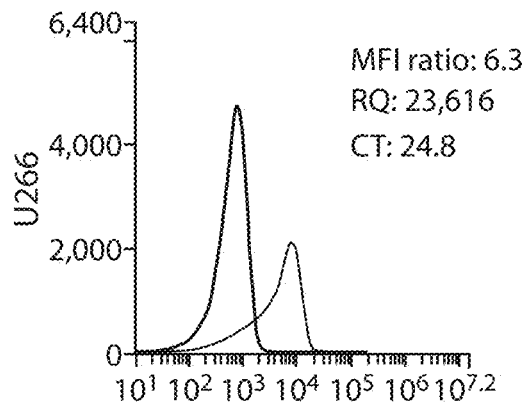
FIGS. 2A, 2B, 2C, 2D, and 2E are a series of graphical representations of BCMA expression in multiple myeloma cell lines and primary samples by flow cytometry. BCMA was detected on the surface of cell lines U266 (FIG. 2A), H929 (FIG. 2B), and 8226 (FIG. 2C). BCMA was also homogenously expressed on the majority of clonal plasma cells in 9 out of 10 multiple myeloma patients analyzed (FIGS. 2D and 2E).
Figure 2B:
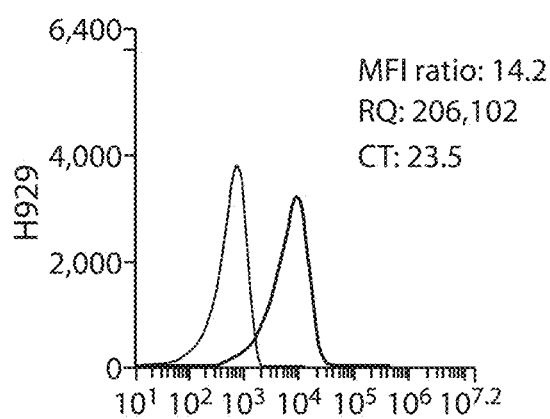
Figure 2C:
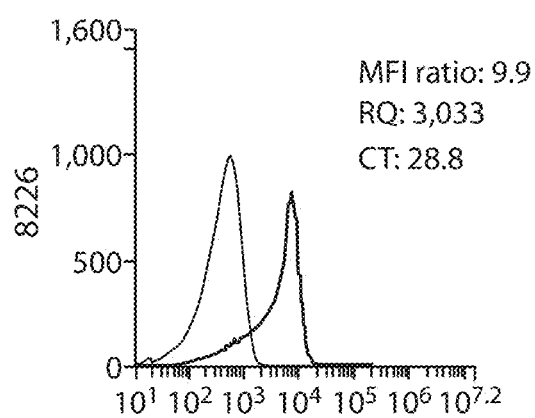
Figure 2D:
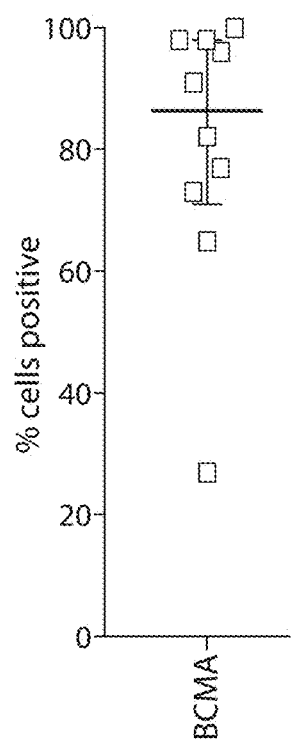
Figure 2E:
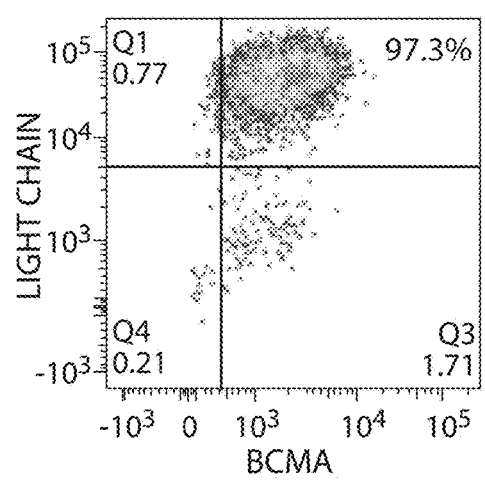

BCMA was detected on the surface of all the 3 MM cell lines as shown in FIGS. 2A, 2B, and 2C. Moreover, BCMA was homogenously expressed on majority of clonal (kappa or lambda restricted) plasma cells in most of the MM patients analyzed (9 of 10). (FIGS. 2D and 2E). These results provide strong support for the relevance of BCMA as a target in MM.

Flow Cytometric Analysis of BCMA Expression in Normal Peripheral Blood Cells, CD3/CD28 Expanded T Cells and Bone Marrow Stem Cells In order to rule out possible off-target expression of BCMA in normal tissues and on T cells, BCMA expression in two bone marrow (BM) and peripheral blood (PB) specimens from voluntary healthy donors, were evaluated by flow cytometry. Mononuclear cells were obtained through Ficoll-Paque (GE healthcare) gradient separation. BM cells were marked with Live/dead dye (LifeTechnologies, L34960) then stained with monoclonal antibodies against, CD34-APC (eBioscience, 17-0349-42, CD38-PECY7(eBioscience, 25-0389-42), human hemopoietic lineage markers mix-FITC (eBioscience, 22-7778-72), CD45RA-APC-eF780 (eBioscience, 47-0458-42, CD90-PerCPCy5.5 (eBioscience, 45-0909-41, CD10-BV421 (Biolegend, 312218) and BCMA-PE (R&D, FAB193P). Fresh PB cells were stained at baseline and following stimulation and expansion with CD3/CD28 beads. PB was stained with monoclonal antibodies against CD14-V500 (BD, 561391), CD45-BV421 (Biolegend, 304032), CD3-AF700 (56-0038-42), CD19-PECY7 (eBioscience, E10328-1632, and BCMA-PE (R&D, FAB193P). Cells were washed twice and staining data acquired in a BD Fortessa cytometer. Flow cytometric analysis was carried out by using FlowJo v10 (Tree Star Inc).

Figure 3A:
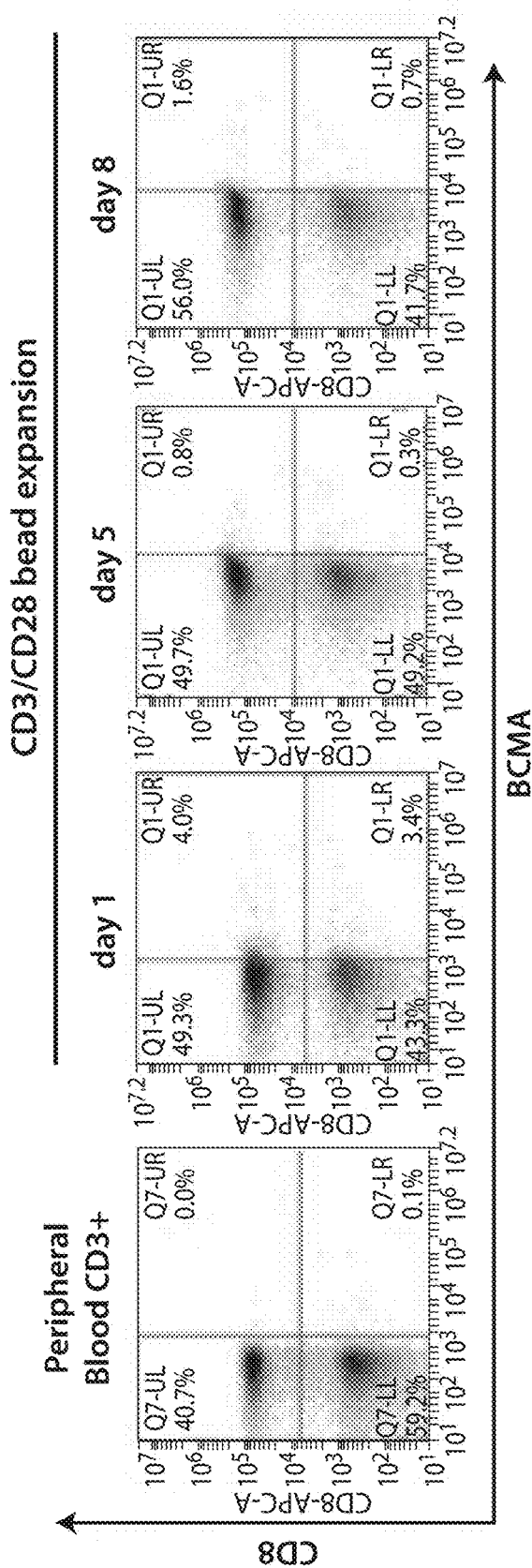
FIGS. 3A and 3B are a series of graphical representations demonstrating the lack of BCMA expression in normal peripheral blood cells and after CD3/CD28 expansion (FIG. 3A) and on normal bone marrow cells (FIG. 3B).
Figure 3B:
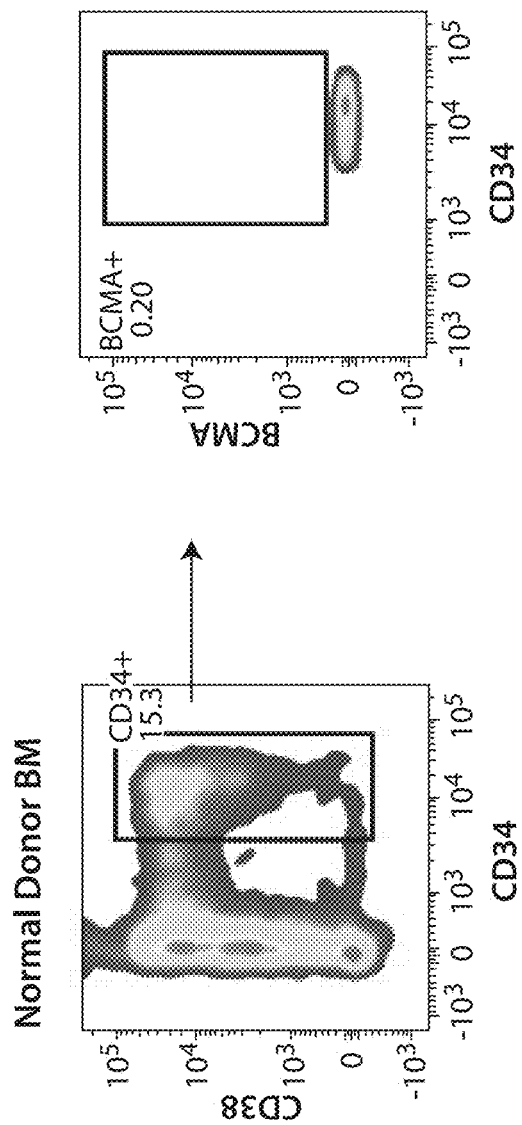

No evidence of BCMA expression was observed on PBMC. Importantly, T cells remained negative for BCMA during expansion. (FIG. 3A) Analysis of different stem cells subsets in the BM revealed no expression of BCMA on immature, lineage negative CD34 positive stem cells. In particular, the Common Lymphocyte Progenitor and the Hemopoietic Stem Cells were negative. (FIG. 3B)

Analysis of BCMA Expression in Normal Tissues by Immunohistochemistry

Three commercially available antibodies (Novus, Sigma) for immunohistochemistry were selected and titrated in paraffin-fixed normal splenic tissue. Tissue micro arrays (TMA) including 27 healthy human tissues were stained by immunohistochemistry.

All 3 antibodies showed positive staining on normal plasma cells in lymph nodes, spleen and tonsil, whereas normal lung, pancreas and thyroid tested negative. Staining, likely non-specific due to the polyclonal nature of the available antibodies, was observed in the following organs: stomach, salivary gland, kidney, adrenal gland, cerebellum, heart and appendix. Selected results are shown in FIGS. 4A-4E and summarized in Table 15.

TABLE 15

BCMA expression by immunohistochemistry staining in normal tissues

| Site | n = | Staining |
| --- | --- | --- |
| Placenta | 2 | neg |
| Adipose | 2 | neg |
| Urinary bladder | 2 | neg |
| Cerebral cortex | 2 | neg |
| Cerebellum | 2 | pos |
| breast | 0 | N/A |
| cervix | 1 | neg |
| colon | 2 | pos |
| diaphragm | 2 | neg |
| Duodenum | 2 | pos |
| Esophagus | 2 | pos |
| Gallbladder | 2 | neg |
| Heart | 2 | neg |
| Ileum | 2 | pos |
| Jejunum | 2 | pos |
| Kidney | 2 | neg |
| Liver | 2 | neg |

TABLE 15-continued

BCMA expression by immunohistochemistry staining in normal tissues

| Site | n = | Staining |
|---|---|---|
| Lung | 2 | neg |
| Ovary | 2 | neg |
| pancreas | 2 | neg |
| Thyroid | 1 | neg |
| Rectum | 2 | pos |
| Skin | 2 | neg |
| Skeletal muscle | 2 | neg |
| Spleen | 2 | pos |
| Stomach | 2 | pos |
| Testes | 2 | neg |
| Thymus | 2 | neg |
| Smooth muscle | 2 | neg |
| Tonsil | 1 | pos |
| Uterus | 2 | neg |

Figure 4A:
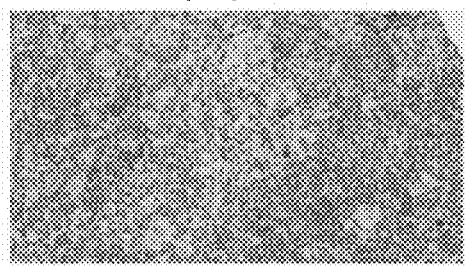
FIGS. 4A, 4B, 4C, 4D, 4E, and 4F are a series of pictures and a graph showing BCMA expression in normal tissues. Tissues that stained positive for BCMA expression in immunohistochemical analysis were lymph node (FIG. 4A) and tonsil (FIG. 4B). Representative tissues that did not stain for BCMA expression (BCMA negative) included lung (FIG. 4C), pancreas (FIG. 4D), and thyroid (FIG. 4E). RNA in situ hybridization analysis in different tissues was also performed (FIG. 4F).
Figure 4B:
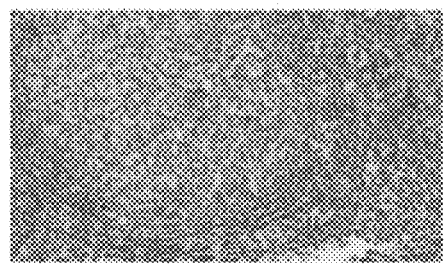
Figure 4C:
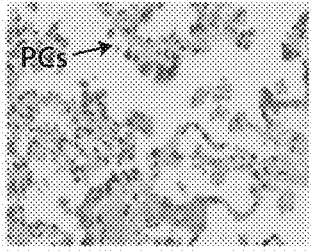
Figure 4D:
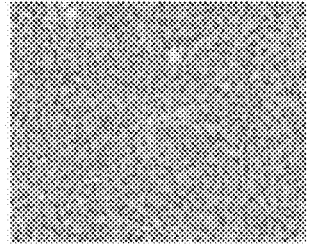
Figure 4E:
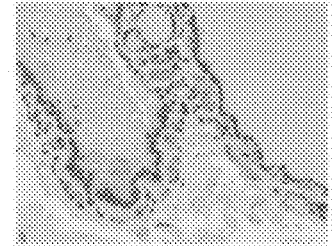
Figure 4F:
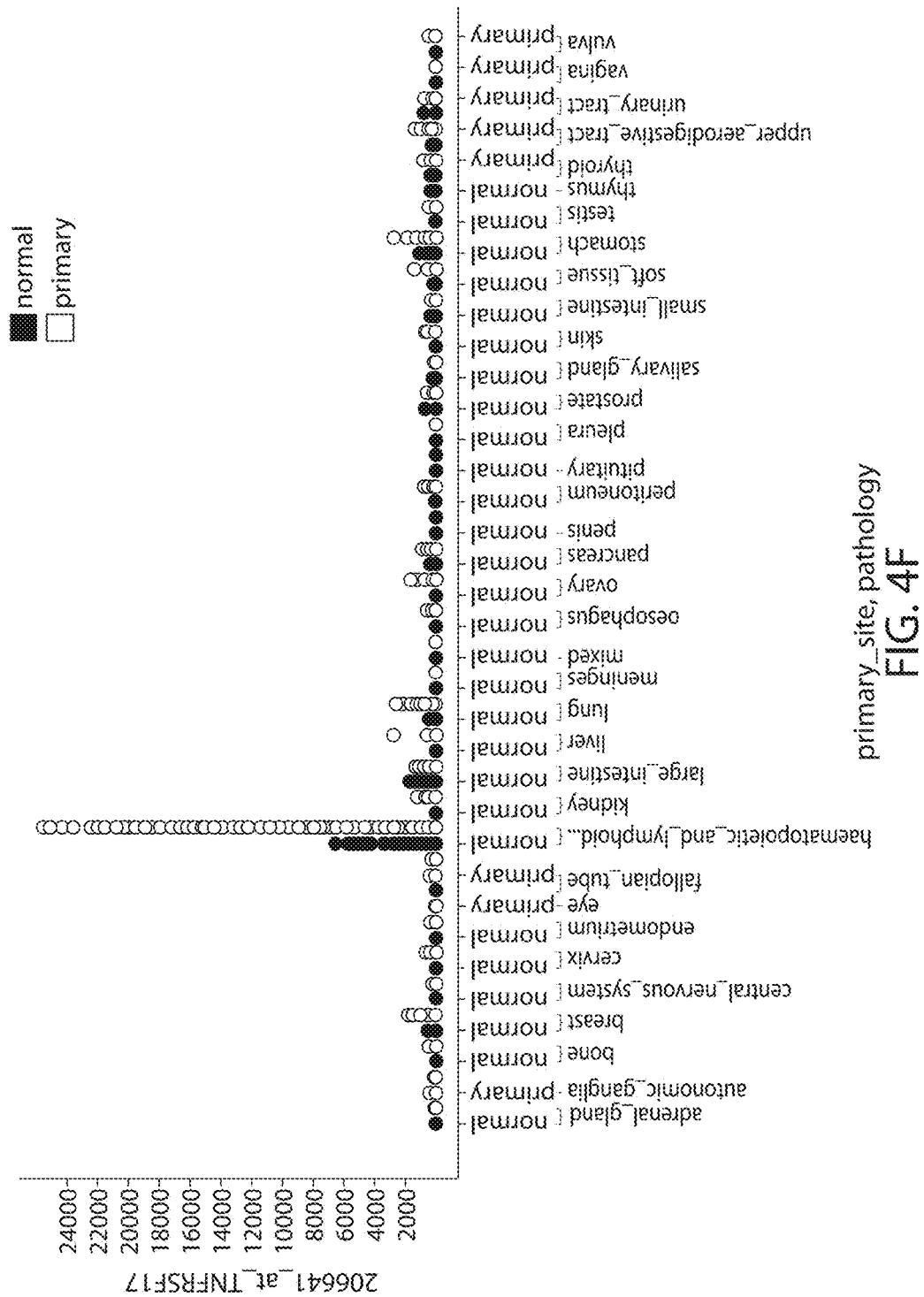

These results led to further analysis of expression, in particular using RNAscope in situ hybridization to confirm the lack of BCMA expression in these tissues. Selected results are shown in FIG. 4F.

Example 2: In Vitro Evaluation of CARs Containing Humanized Anti-BCMA scFv

BCMA CAR Constructs Generated from Humanized Mouse Anti-BCMA Antibody

Four distinct anti-BCMA CARs constructs were designed using the VL and VH sequences disclosed in PCT Publication WO 2012/163805 (the contents of which are hereby incorporated by reference in its entirety). In order to create the anti-BCMA CARs, the VH and VL sequences were synthesized and joined with a [Gly-Gly-Gly-Gly-Ser]×4 linker (SEQ ID NO: 27) creating two single-chain variable fragments (scFvs) in which the VH precedes the VL (H2L, SEQ ID NO: 255) or the VL precedes the VH (L2H, SEQ ID NO: 257). The CD8 leader was also synthesized and fused to the 5' end of each scFv with a BamHI site Restriction sites for XbaI and BspE1 were included at the 5' and 3' ends, respectively, at the time of synthesis to facilitate cloning of the CD8 leader-scFvs into the pTRPE lentiviral vector containing the hinge and CD8TM regions with 4-1BB and CD3z cytoplasmic domains. Two separate CAR backbone constructs were used for the cloning, one containing a human CD8 hinge and the other containing a human IgG4 hinge to generate the 4 anti-BCMA CAR constructs shown schematically in FIG. 5, designated pBCMA 1, pBCMA 2, pBCMA 3, and pBCMA 4. To produce infectious lentiviral vector supernatants, 293-T cells were transfected with the following plasmids: pTRP-VSV-G (encoding the vesicular stomatitis virus (VSV-G) envelope), pTRP gag/pol (encoding gag and pol) and pTRP-Rev with either of the four BCMA CAR constructs utilizing lipofectamine 2000 (Invitrogen).

The nucleic acid sequence of humanized anti-BCMA scFv in which VH precedes the VL (H2L, e.g., pBCMA 2 and pBCMA 4) is as follows:

(SEQ ID NO: 272)
CAGGTGCAGCTGGTCCAGAGCGGCGCCGAAGTGAAGAAGCCCGGCAGCTC

CGTGAAAGTGAGCTGCAAGGCCAGCGGCGGCACCTTCAGCAACTACTGGA

TGCACTGGGTGAGGCAGGCCCCCGGACAGGGCCTGGAGTGGATGGGCGCC

ACCTACAGGGGCCACAGCGACACCTACTACAACCAGAAGTTCAAGGGCCG

GGTGACCATCACCGCCGACAAGAGCACCAGCACCGCCTACATGGAACTGA

GCAGCCTCAGGAGCGAGGACACCGCTGTGTATTACTGCGCCAGGGGCGCC

ATCTACAACGGCTACGACGTGCTGGACAACTGGGGCCAGGGCACACTAGT

GACCGTGTCCAGCGGTGGAGGAGGTAGCGGAGGAGGCGGGAGCGGTGGAG

GTGGCTCTGGAGGTGGCGGAAGCGACATCCAGATGACCCAGAGCCCTAGC

TCACTGAGCGCCAGCGTGGGCGACAGGGTGACCATTACCTGCTCCGCCAG

CCAGGACATCAGCAACTACCTGAACTGGTACCAGCAGAAGCCCGGCAAGG

CCCCCAAGCTGCTGATCTACTACACCTCCAACCTGCACTCCGGCGTGCCC

AGCAGGTTCAGCGGAAGCGGCAGCGGCACCGATTTCACCCTGACCATCTC

CAGCCTGCAGCCCGAGGACTTCGCCACCTACTACTGCCAGCAGTACAGGA

AGCTCCCCTGGACTTTCGGCCAGGGCACCAAACTGGAGATCAAGCGT

The corresponding amino acid sequence for the humanized anti-BCMA scFv in which Vh precedes the VL (H2L, e.g., pBCMA 2 and pBCMA 4) is as follows:

(SEQ ID NO: 271)
Q V Q L V Q S G A E V K K P G S S V K V S C K A S

G G T F S N Y W M H W V R Q A P G Q G L E W M G A

T Y R G H S D T Y Y N Q K F K G R V T I T A D K S

T S T A Y M E L S S L R S E D T A V Y Y C A R G A

I Y N G Y D V L D N W G Q G T L V T V S S G G G G

S G G G G S G G G G S G G G G S D I Q M T Q S P S

S L S A S V G D R V T I T C S A S Q D I S N Y L N

W Y Q Q K P G K A P K L L I Y Y T S N L H S G V P

S R F S G S G S G T D F T L T I S S L Q P E D F A

T Y Y C Q Q Y R K L P W T F G Q G T K L E I K R

The nucleic acid sequence of humanized anti-BCMA scFv in which VL precedes the VH (L2H, e.g., pBCMA1 and pBCMA3) is as follows:

(SEQ ID NO: 274)
GACATCCAGATGACCCAGAGCCCTAGCTCACTGAGCGCCAGCGTGGGCGA

CAGGGTGACCATTACCTGCTCCGCCAGCCAGGACATCAGCAACTACCTGA

ACTGGTACCAGCAGAAGCCCGGCAAGGCCCCCAAGCTGCTGATCTACTAC

ACCTCCAACCTGCACTCCGGCGTGCCCAGCAGGTTCAGCGGAAGCGGCAG

CGGCACCGATTTCACCCTGACCATCTCCAGCCTGCAGCCCGAGGACTTCG

CCACCTACTACTGCCAGCAGTACAGGAAGCTCCCCTGGACTTTCGGCCAG

GGCACCAAACTGGAGATCAAGCGTGGTGGAGGAGGTAGCGGAGGAGGCGG

GAGCGGTGGAGGTGGCTCTGGAGGTGGCGGAAGCCAGGTGCAGCTGGTCC

AGAGCGGCGCCGAAGTGAAGAAGCCCGGCAGCTCCGTGAAAGTGAGCTGC

AAGGCCAGCGGCGGCACCTTCAGCAACTACTGGATGCACTGGGTGAGGCA

GGCCCCCGGACAGGGCCTGGAGTGGATGGGCGCCACCTACAGGGGCCACA

GCGACACCTACTACAACCAGAAGTTCAAGGGCCGGGTGACCATCACCGCC

-continued

```
GACAAGAGCACCAGCACCGCCTACATGGAACTGAGCAGCCTCAGGAGCGA

GGACACCGCTGTGTATTACTGCGCCAGGGGCGCCATCTACAACGGCTACG

ACGTGCTGGACAACTGGGGCCAGGGCACACTAGTGACCGTGTCCAGC
```

The corresponding amino acid sequence of humanized anti-BCMA scFv in which VL precedes the VH (L2H, e.g., pBCMA1 and pBCMA3) is as follows:

```
                                          (SEQ ID NO: 273)
DIQMTQSPSS LSASVGDRVT ITCSASQDIS NYLNWYQQKP

GKAPKLLIYY TSNLHSGVPS RFSGSGSGTD FTLTISSLQP

EDFATYYCQQ YRKLPWTFGQ GTKLEIKRGG GGSGGGGSGG

GGSGGGGSQV QLVQSGAEVK KPGSSVKVSC KASGGTFSNY

WMHWVRQAPG QGLEWMGATY RGHSDTYYNQ KFKGRVTITA

DKSTSTAYME LSSLRSEDTA VYYCARGAIY NGYDVLDNWG

QGTLVTVSS
```

These pBCMA-CARs containing humanized anti-BCMA scFvs are utilized in the experiments detailed below and in Example 3.

Efficient Expression of BCMA-CARs on T Cells

Fresh isolated human T cells from healthy donors were transduced with lentiviral vector supernatants encoding the pBCMA 1 to 4 CARs, and anti-BCMA CAR expression was evaluated by flow cytometry. Briefly, T cells were cultured in RPMI 1640 medium with 10% FBS and stimulated with anti-CD3/anti-CD28 Dynabeads (Invitrogen). 24 hrs after stimulation, T cells were transduced with the four different pBCMA CAR lentiviral vector supernatants. T cells transduced with an anti-mesothelin CAR (SS1) vector were used as a positive control. Mock-transduced T cells (NTD) were used as a negative control. 4-6 days after lentiviral transduction T cells were stained with biotinylated Protein L antibody followed by strepavidin FITC (BD Biosciences) or Biotin Goat-anti mouse and CAR expression was evaluated by flow cytometry (FACS Calibur, BD). Flow cytometric analysis was carried out by using Flowjo (Tree Star Inc).

Figure 6:
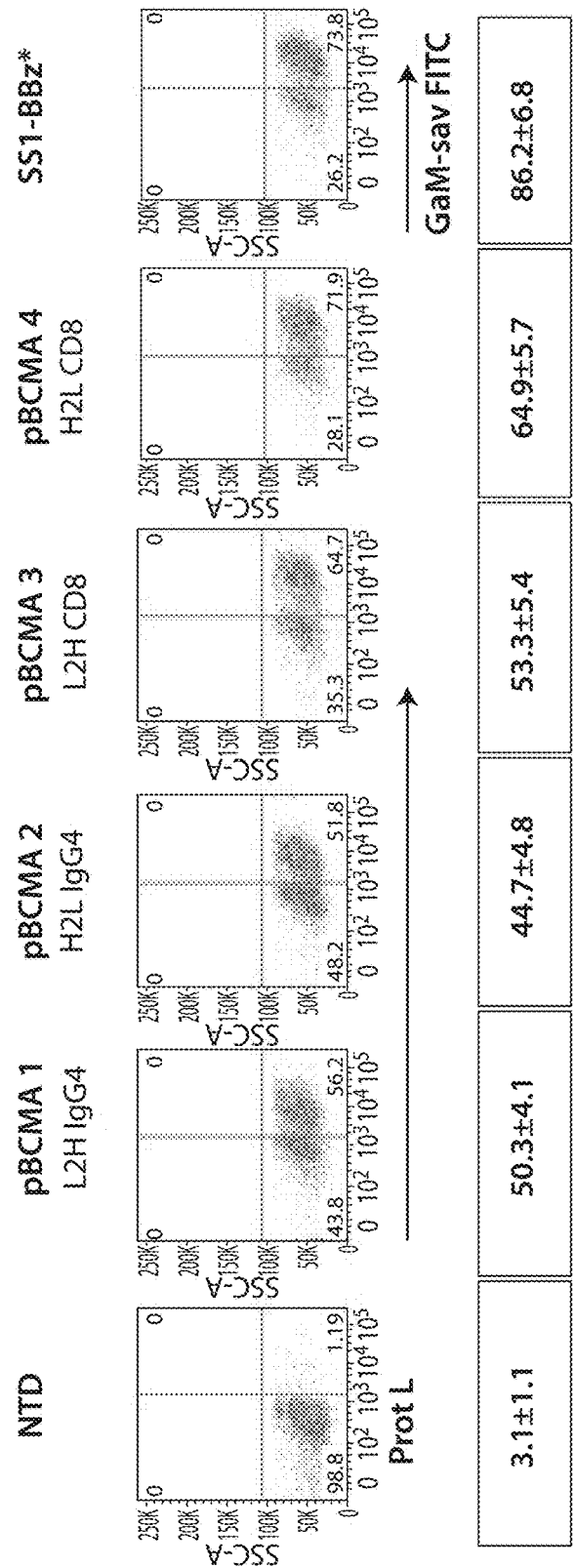
FIG. 6 is a series of flow cytometry plots showing the transduction efficiency and expression of the BMCA-CAR constructs on T cells. SS1-BBz represents anti-mesothelin CAR, which serves as a negative control.

After transduction it was observed that pBCMA CARs were efficiently expressed on the cell surface of the transduced T cells as shown in FIG. 6.

Cytokine Production from Anti-BCMA CAR-Expressing T Cells (BCMA CARTs)

K562 cells ectopically expressing human BCMA (K562-BCMA) were generated by lentiviral transduction using a vector supplied by GeneCopoeia followed by puromycin selection. K562-BCMA specific target cells were utilized in vitro to evaluate cytotoxic and cytokine production from pBCMA 1-4 CAR-transduced T cells. Anti-pBCMA CAR T cells or control T cells were expanded until the end of log-phase growth and subsequently co-cultured for 16 hrs with either K562-BCMA specific target cells, K562-Mesothelin target cells as positive control or no target cells as negative control at a 3 to 1 ratio of effector cells to target cells. Culture supernatants were harvested and IFN-gamma and IL-2 concentration was measured by specific ELISA following manufacturer instructions (R&D).

Figure 7A:
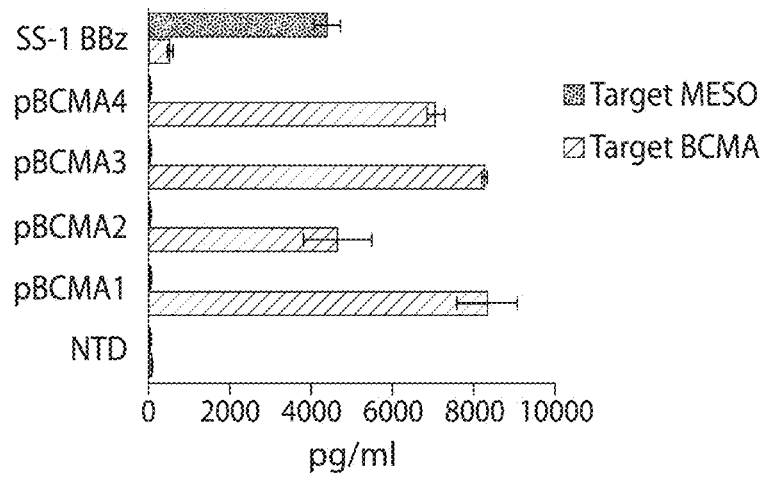
FIG. 7A and FIG. 7B are two graphs demonstrating the antigen-specific cytokine production of BCMA-CARTs, as measured by ELISA assays. IL2 (FIG. 7A) and interferon-gamma (IFNg) (FIG. 7B) production was assessed.
Figure 7B:
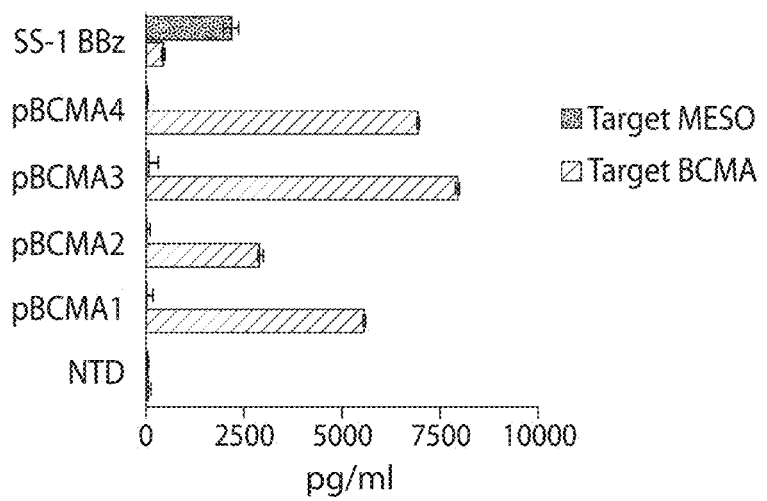
Figure 8A:
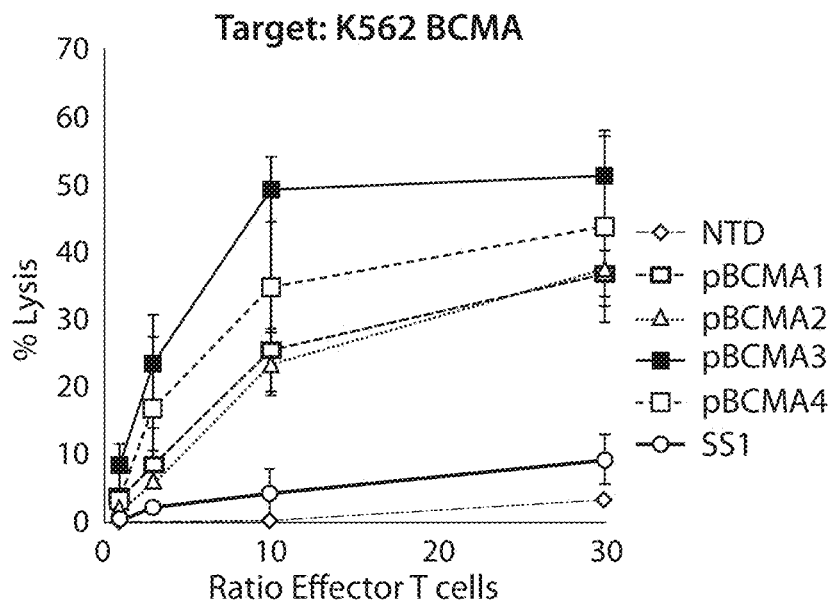
FIG. 8A, FIG. 8B, FIG. 8C, and FIG. 8D are a series of graphs demonstrating the cyotoxic activity BCMA-CARTs on the indicated myeloma cell lines: K562-expressing BCMA (FIG. 8A); 8226 (FIG. 8B); NCI H929 (FIG. 8C); and OPM2 (FIG. 8D).
Figure 8B:
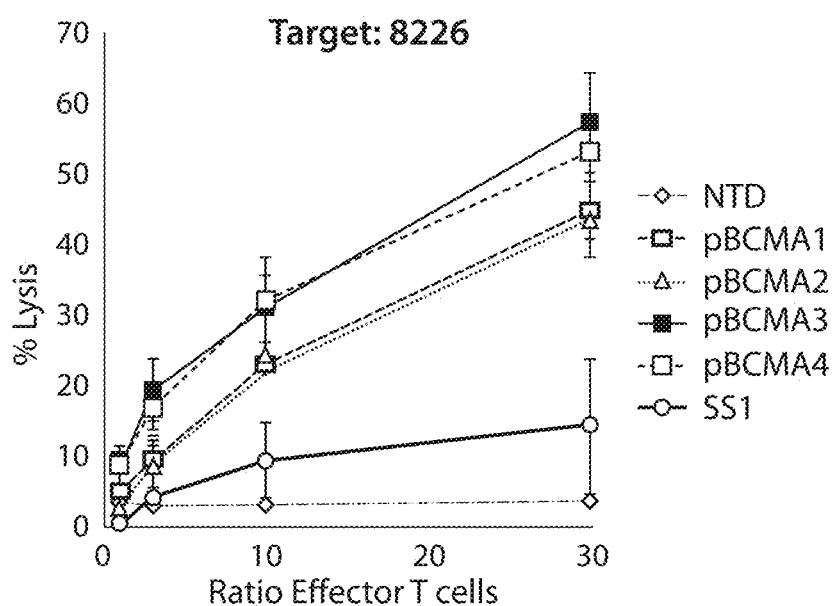
Figure 8C:
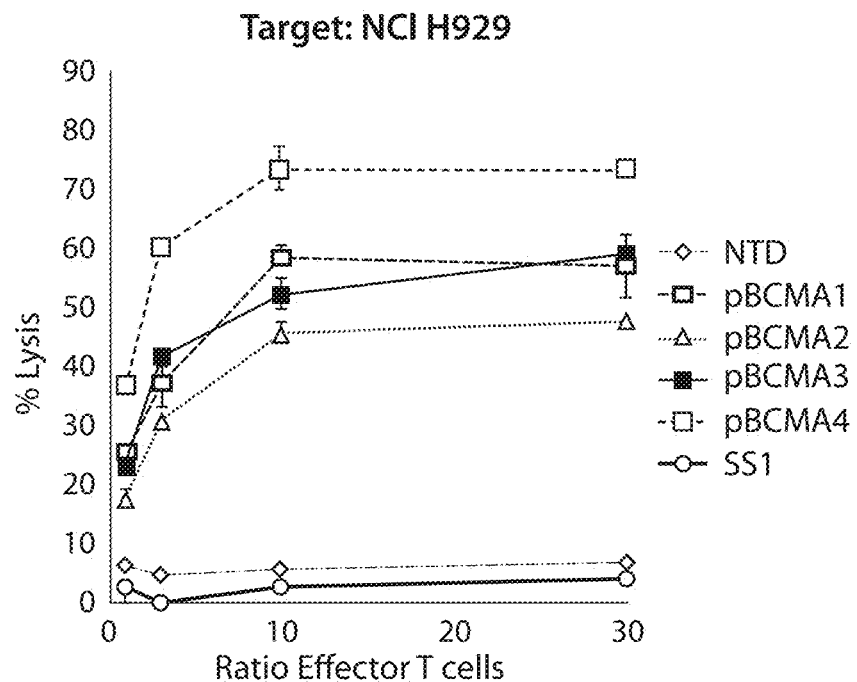
Figure 8D:
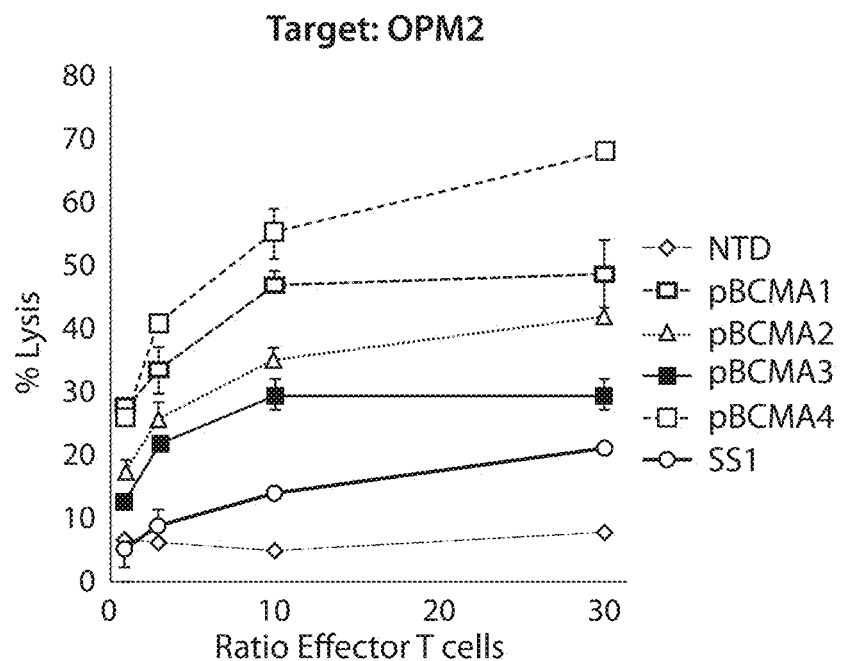

T cells expressing all four anti-pBCMA CARs produced similar levels of IFN-gamma and IL-2 when co-cultured with BCMA-expressing target cells but not with BCMA-negative target cells as shown in FIGS. 7A and 7B.

Cytotoxic Activity of BCMA CARTs on Myeloma Cell Lines

The ability of pBCMA CAR T cells to kill BCMA-expressing target cells was evaluated using a $^{51}$Cr release-assay. Briefly, target MM cells were labeled with $^{51}$Cr (Sodium Dichromate salt), washed and co-cultured with effector pBCMA CAR T cells at different effector/target ratios. Supernatants were collected at 4-hrs, and placed into 96 well Lumaplates (Perkin Elmer). The amount of $^{51}$Cr released from the labeled target cells was measured on a liquid scintillation counter (MicroBeta trilux, Perkin Elmer). Target cells incubated in medium alone or with 1% SDS were used to determine spontaneous (S) or maximum (M)$^{51}$Cr release. Percentage of specific lysis was calculated as follow: 100×(cpm experimental release−cpm S release)/(cpm M release−cpm S release).

All four pBCMA-CAR-transduced T cells were able to induce lysis of K562-BCMA cells and BCMA-expressing multiple myeloma cells lines with little activity towards the BCMA negative cell lines as shown in FIGS. 8A, 8B, 8C, and 8D. pBCMA-CARs with a CD8 hinge (pBCMA 3 and 4) exhibited greater cytotoxicity compared with pBCMA CARs containing the IgG4 hinge, suggesting that the hinge is an important factor in the CAR design for optimal function.

Example 3: In Vivo Evaluation of pBCMA-CARTs for Multiple Myeloma

Based upon in vitro data supporting enhanced function of pBCMA 3 and pBCMA 4 CAR-modified T cells, the anti-tumor activity of these CARTs was evaluated in a preclinical animal model of multiple myeloma using the RPMI 8226 cell line. RPMI 8226 cells were engineered to express Click-beetle Green luciferase (CB-G Luc$^+$) to track tumor progression by bioluminescent in vivo imaging (IVIS) and Living Image software (Perkin Elmer). 4 weeks after injection of CB-G Luc$^+$ RPMI 8226 cells were IV injected in NSG recipients, T cells expressing pBCMA 3 CAR, pBCMA 4 CAR, CD19 CAR (FMC63 anti-CD19 scFv with human CD8 hinge, 4-1BB and CD3z cytoplasmic domain) or SS1 CAR (SS1 anti-mesothelin scFv with human CD8 hinge, 4-1BB and CD3z cytoplasmic domain) were IV injected and the tumor burden was evaluated by optical imaging as well as by the appearance of clinical signs of disease (Table 16 below). Scoring was performed as follows: 1-no clinical signs; 2-minor gait change/minor tumor mass; 3-decreased mobility/tumor mass/still ambulatory; 4-hind limb paralysis/big tumor mass/END POINT; and 5-complete limb paralysis.

TABLE 16

Treatment Groups and Clinical Scoring.

| Groups | Scoring Day 50 |
| --- | --- |
| BCMA3 | 2 |
| BCMA4 | 2 |
| SS1 | 3 |
| CD19 | 4 |
| CTL | 4 |

Figure 9A:
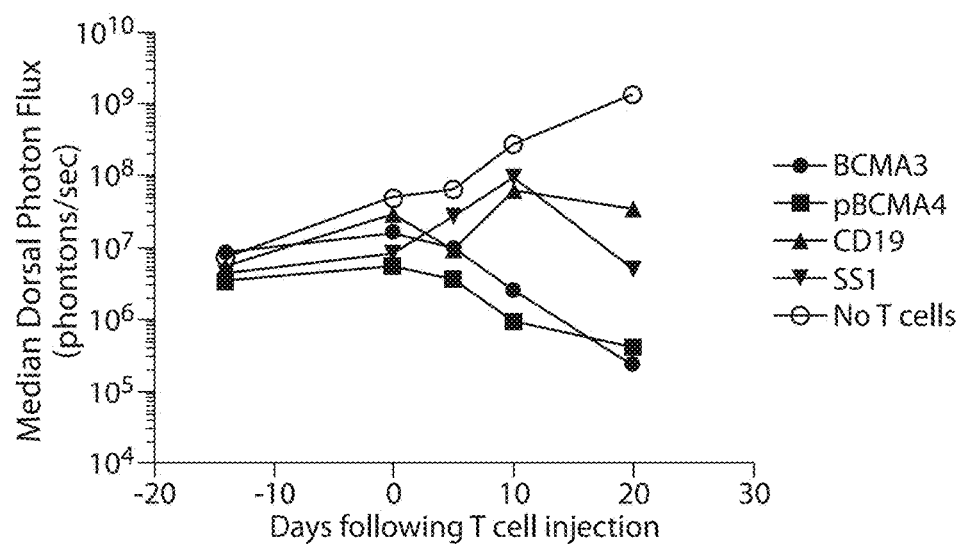
FIG. 9A and FIG. 9B are a graph and a series of pictures showing the anti-tumor activity of the BCMA-CARTs in a preclinical multiple myeloma animal model.
Figure 9B:
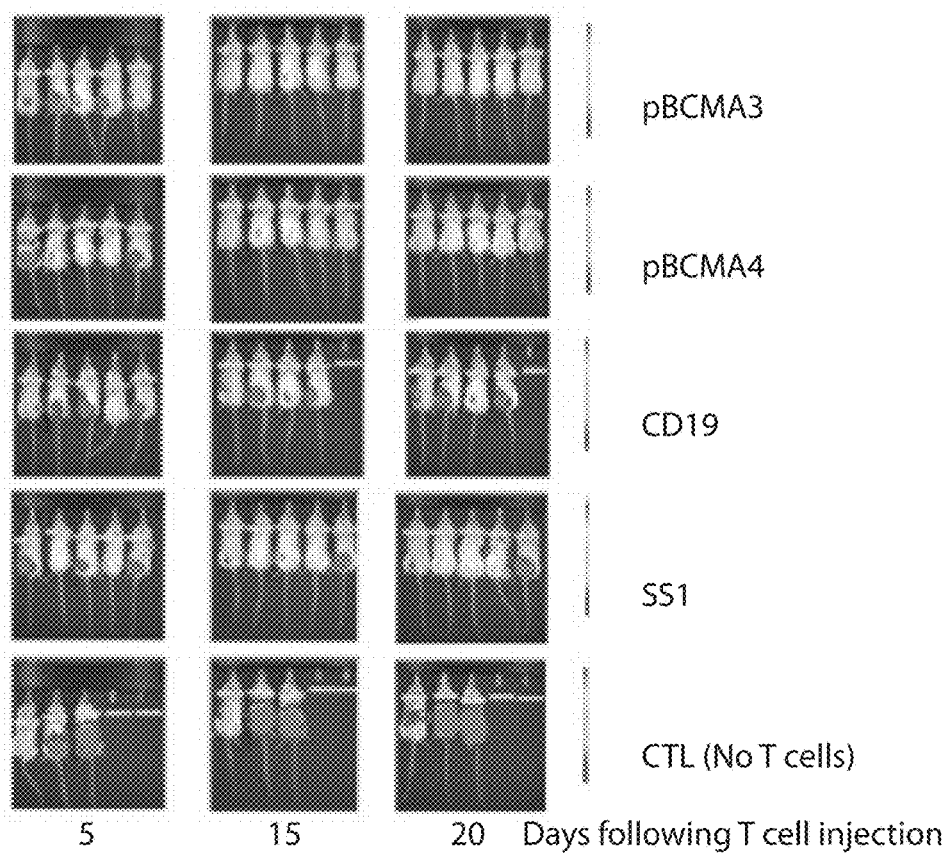

T cells expressing either the pBCMA-3 and pBCMA 4 CAR T cells induce a significant reduction in the tumor burden of mice bearing RPMI 8226 as well as improved clinical disease activity compared with control T cells targeting mesothelin (designated SS1) or CD19 as shown in FIGS. 9A and 9B.

The experiments described in Examples 2 and 3 provided the rationale to identify human scFv binding domains for additional CAR constructs, which are described and assessed in Examples 4-7.

Example 4: Generating Human Anti-BCMA CAR Constructs

Human BCMA-specific scFvs for CAR constructs were identified by 3 rounds of bead-based Bio-BCMA panning. In Arm 1, SBAL-1Sk Phage Library (8.4E13) was used. In Arm 2, SBAL-3Sk(G1+G2+G4+G5) Phage Library (1E13) was used. The phage lysates were screened for BCMA reactivity by ELISA. 319 positive hits were identified, representing 135 unique sequences. The phage sequences were converted to soluble scFv that can be expressed in *E. coli*. The *E. coli* lysates were next screened by ELISA, and the periplasm was screened by FACs. 15 hits were identified by the FACs analysis. Next, the scFvs were purified from the *E. coli* and the purified scFvs were tested by FACs. 15 scFvs were confirmed, and were designated BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, and BCMA-15. The sequences of human anti-BCMA scFv fragments (SEQ ID NOS: 39-52), are provided in Table 8 (and the name designations are provided in Table 7). Full BCMA CAR constructs (SEQ ID NOs: 99-113) were generated using the human scFv fragments (SEQ ID NOs: 39-52) in combination with the additional sequences shown in the Detailed Description, e.g., leader, CD8 hinge, CD8 transmembrane, 4-1BB intracellular domain, CD27 intracellular domain, CD28 intracellular domain, ICOS domain, CD3zeta domain (mutant), human CD3zeta domain, IgG4 hinge, Gly/Ser sequences, and/or Poly(A) sequences.

The CAR scFv fragments were then cloned into lentiviral vectors to create a full length CAR construct in a single coding frame, and using the EF1 alpha promoter for expression (SEQ ID NO: 11).

The amino acid and nucleic acid sequences of the BCMA scFv domains and BCMA CAR molecules are provided in Table 8 in the Detailed Description. Table 7 in the Detailed Description designates the nicknames for the BCMA CAR constructs with respect to the DNA ID number, also listed in Table 8.

Additional tool BCMA CAR constructs were also generated using the VH and VL sequences from PCT Publication WO2012/0163805 (the contents of which are hereby incorporated by reference in its entirety), and are based upon the results from the pBCMA3 and pBCMA4 CARs described in Examples 2 and 3. A schematic of the tool BCMA constructs (BCMA-3NP and BCMA-4NP) is shown in FIG. 10A. The two constructs differ in the orientation of the VH and VL chains (FIG. 10B). The tool BCMA CAR constructs and their corresponding DNA ID are shown below.

TABLE 17

Tool CAR construct IDs

| Nickname | Novartis ID | DNA2.0 ID |
|---|---|---|
| BCMA-3NP | | 126022 |
| BCMA-4NP | | 126021 |

Additional BCMA CAR constructs can also be generated using the VH and VL sequences found in Table 10 in the Detailed Description. The amino acid sequences of exemplary scFv domains comprising the VH and VL domains and a linker sequence, and full-length CARs are also found in Table 10.

Production and Calculation of Viral Titer for BCMA CAR Constructs

Lentiviral supernatants were generated from 15 BCMA-specific CAR constructs obtained from scFv phage screening (Table 7). Lentiviral supernatants for 2 BCMA tool CAR constructs, BCMA-3NP and BCMA-4NP, were also generated. The tool constructs described in this example are based on the pBCMA3 and pBCMA4 constructs previously described in Examples 2 and 3.

To generate lentiviral supernatants, LentiX-293T cells were seeded on Day 0 and transfected on Day 1 with Lipofectamine 2000 transfection reagent (Life Technologies). For each construct, the plasmid DNA used was: pRSV.REV (Rev expression plasmid), pMDLg/p.RRE (Gag/Pol expression plasmid), pVSV-G (VSV glycoprotein expression plasmid), and CAR transfer vector. The transfection mixture was replaced with fresh medium on Day 2, and viral supernatant were collected on Days 3 and 4.

Viral supernatants were concentrated using Lenti-X Concentrator reagent (Clontech), and the resulting pellets were resuspended in growth medium at 1/10 to 1/100 of the original volume. Concentrated viral supernatants were aliquoted and stored at −80° C. Calculation of viral titer was determined by transducing SupT1 cells and assessing CAR expression. SupT1 cells were transduced on Day 1 with a 3-fold serial dilution series of viral supernatants with a starting concentration of 1:300. CAR expression was assessed on Day 5 with BCMA-Fc antigen (R&D Systems) and Biotin-Protein L reagent (GenScript). Viral titer was calculated according to the following formula:

(% CAR+)×(#SupT1cells)/(Amount of Virus (ml))× (Dilution)

Average viral titer was calculated from dilution points in the linear range between 1 and 20% CAR-positive. Titer calculations for BCMA CAR clones are shown in Table 18.

TABLE 18

Titer of lentiviral supernatants from LentiX-293T cells transduced with BCMA-targeting CARs as measured by either BCMA-Fc or Protein L.

| Clone | BCMA-Fc titer (TU/ml) | Protein L titer (TU/ml) |
|---|---|---|
| BCMA-1 | 1.27E+08 | 7.54E+06 |
| BCMA-2 | 1.02E+08 | 1.43E+08 |
| BCMA-4 | 1.46E+08 | 1.58E+08 |
| BCMA-5 | 9.98E+07 | 9.64E+07 |
| BCMA-6 | 1.41E+08 | 4.82E+06 |
| BCMA-7 | 6.41E+07 | 5.53E+07 |
| BCMA-8 | 6.15E+07 | 6.98E+07 |
| BCMA-9 | 8.57E+07 | 7.75E+07 |
| BCMA-10 | 6.73E+07 | 8.77E+07 |
| BCMA-11 | 4.60E+07 | 5.43E+06 |
| BCMA-12 | 4.88E+07 | 5.97E+07 |
| BCMA-13 | 9.96E+07 | 5.52E+07 |
| BCMA-14 | 9.88E+07 | 1.20E+08 |
| BCMA-15 | 7.39E+07 | 7.41E+07 |
| BCMA-3NP | 5.38E+07 | 6.11E+07 |
| BCMA-4NP | 5.35E+07 | 5.37E+07 |

All BCMA CAR clones were detected with BCMA-Fc antigen, but detection was weaker with Biotin-Protein L for a number of clones (BCMA-1, BCMA-6, BCMA-11). Titers based on BCMA-Fc detection were used to calculate MOI for transduction in primary T cells. The BCMA CAR constructs containing human anti-BCMA scFvs described in this example are used throughout the experiments in Examples 4 and 5. The tool BCMA CAR constructs described in this example are also used in the experiments described in Examples 5, 6, and 7.

Example 5: In Vitro Characterization of Tool BCMA CAR Constructs

JNL Reporter Assay for Tool BCMA CAR Constructs

Figure 11:
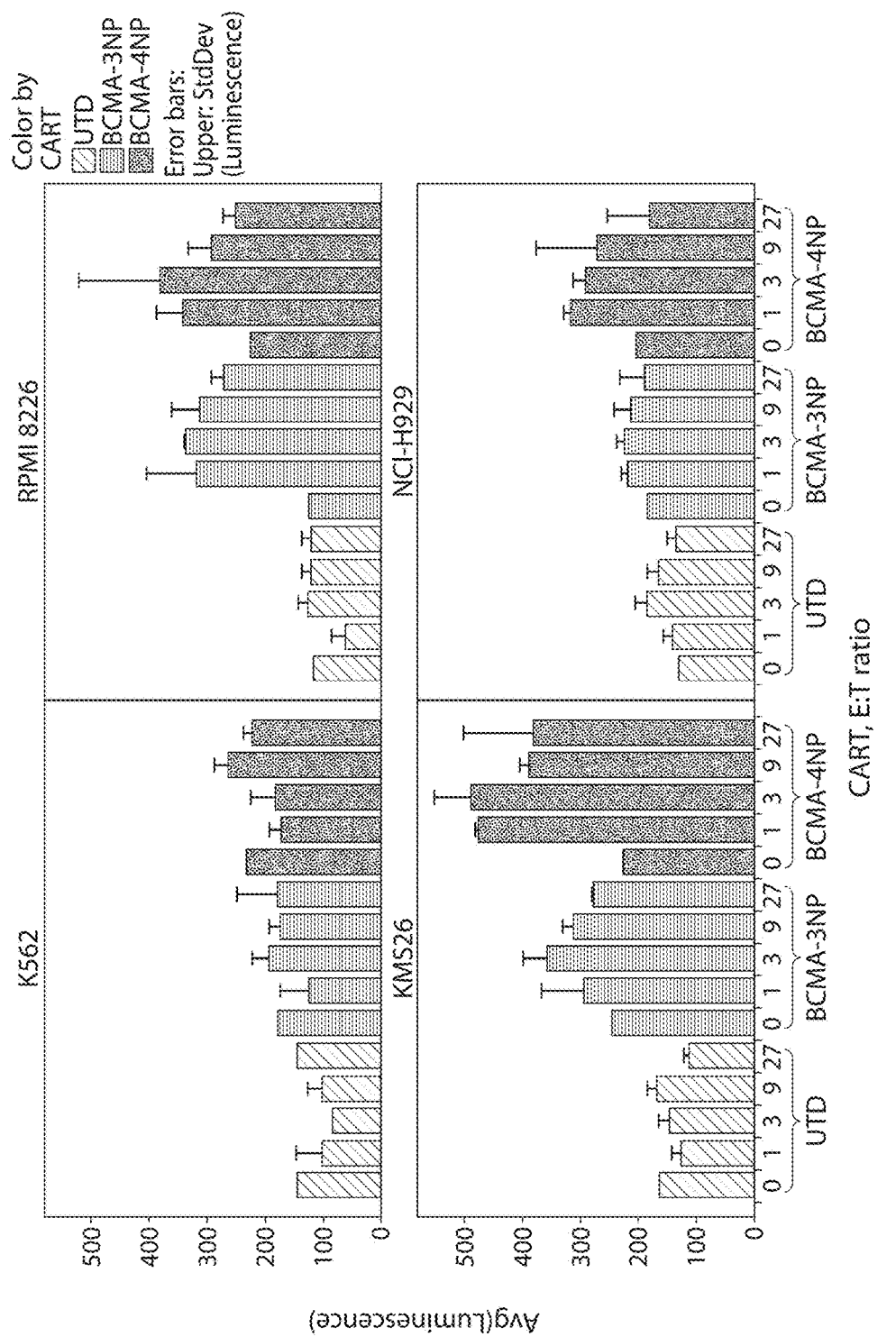
FIG. 11 is a series of graphs demonstrating target-specific activation of tool BCMA CAR constructs tranduced in a reporter cell line by luciferase reporter assay.

Jurkat-NFAT-luciferase (JNL) cells transduced with the tool BCMA CAR constructs were evaluated for activation in response to BCMA-expressing target cell lines. On Day 0, JNL cells were transduced with BCMA-3NP and BCMA-4NP. Virus concentrations were adjusted to a MOI of 3 and incubated overnight. On Day 6 following transduction, BCMA CAR-transduced JNL cells were incubated with target cells at effector-to-target (E:T) ratios ranging from 0 to 27. Target cell lines were: K562 (BCMA negative control), and BCMA positive multiple myeloma cell lines, NCI-H929, KMS26, and RPMI 8226. JNL activation was measured using Bright-Glo substrate (Promega) on Day 7. CAR expression on transduced JNL was assessed on Day 6 with BCMA-Fc antigen (Table 19). This reporter assay demonstrates that the tool BCMA-targeting CAR clones are activated in a target-specific manner (FIG. 11).

TABLE 19

Percent CAR expression on JNL cells

| Clone | BCMA-Fc detection % CAR+ |
|---|---|
| BCMA-3NP | 31.2 |
| BCMA-4NP | 41.9 |

Figure 12:
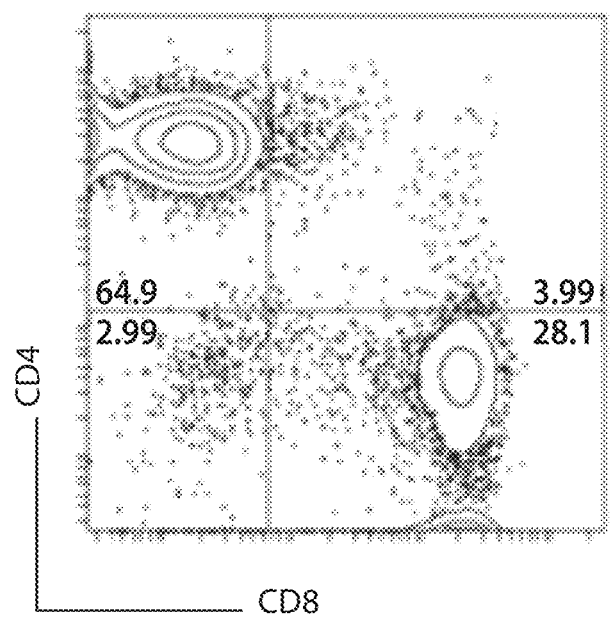
FIG. 12 is a flow cytometry plot showing the distribution of CD4+ and CD8+ populations of T cells after CD3/CD28 expansion prior to transduction with tool BCMA CAR constructs.

Schedule for isolation, transduction and activation of primary T cells with BCMA-targeting tool CARs is shown in Table 20. On Day 0, healthy human donor PBMCs (Novartis Employee Blood Donor program) were isolated from whole blood by Ficoll extraction, and T cells were isolated from PBMC by negative selection using the Pan T Cell Isolation Kit II (Miltenyi Biotec). Isolated T cells were stimulated overnight with Dynabeads Human T-Expander CD3/CD28 beads (Life Technologies) at a 3:1 ratio of beads-to-cells. T cells were also stained to assess relative amounts of CD4+ and CD8+ cells (FIG. 12).

TABLE 20

Schedule for T cell expansion of BCMA CAR transduced clones

| Day # | Activity |
|---|---|
| 0 | Isolate and activate T cells |
| 1 | Transduce T cells (MOI = 5) |
| 2 | Add medium - 0.5 ml/well |
| 3 | |
| 4 | Split 1:2 |
| 5 | |
| 6 | Split 1:2 (Split UTD control 1:2.5) |
| 7 | |
| 8 | |
| 9 | Split 1:2 |
| 10 | |
| 11 | De-bead and freeze aliquots |

Figure 13:
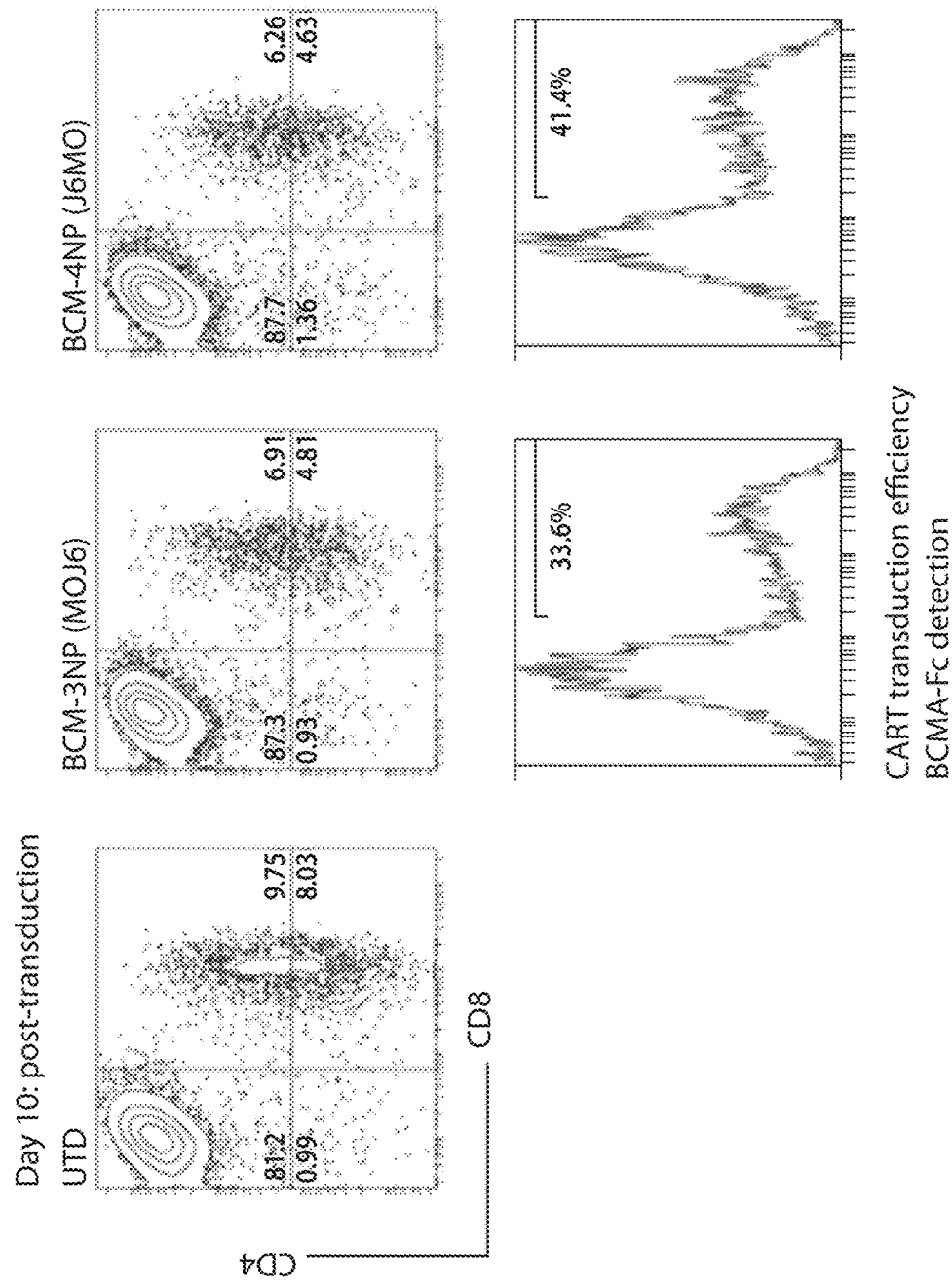
FIG. 13 is a series of plots showing CART transduction efficiency by detection of the BCMA-Fc antigen 10 days after transduction by flow cytometry analysis and corresponding histograms.

On Day 1, T cells were transduced with BCMA-3NP and BCMA-4NP. Virus concentrations were adjusted to a MOI of 5 and incubated overnight. On Day 11, transduced CART cells were de-beaded and frozen in aliquots in 90% FBS, 10% DMSO. Following transduction and expansion, T cells were again stained to assess relative amounts of CD4+ and CD8+ cells. In addition, CAR expression was assessed with BCMA-Fc antigen (FIG. 13).

BCMA Proliferation Assay

Figure 14:
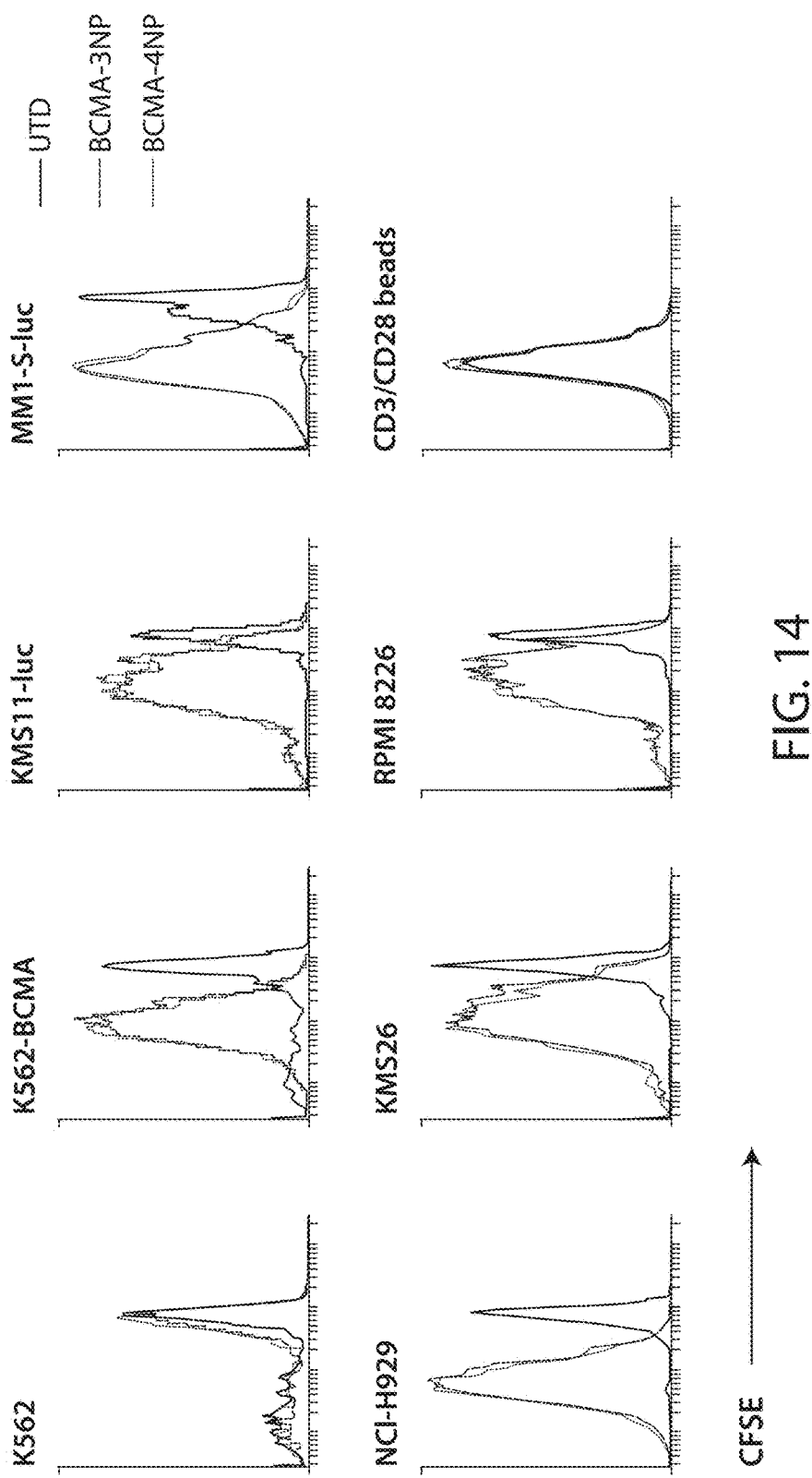
FIG. 14 is a series of histogram plots showing proliferation of the tool BCMA CART cells by CFSE staining after stimulation with the indicated target cells (e.g., K562, K562 expressing BCMA, KMS11-luc, MM1-S-luc, NCI-H929, KMs26, RPMI 8226, and CD3/CD28 beads).
Figure 15A:
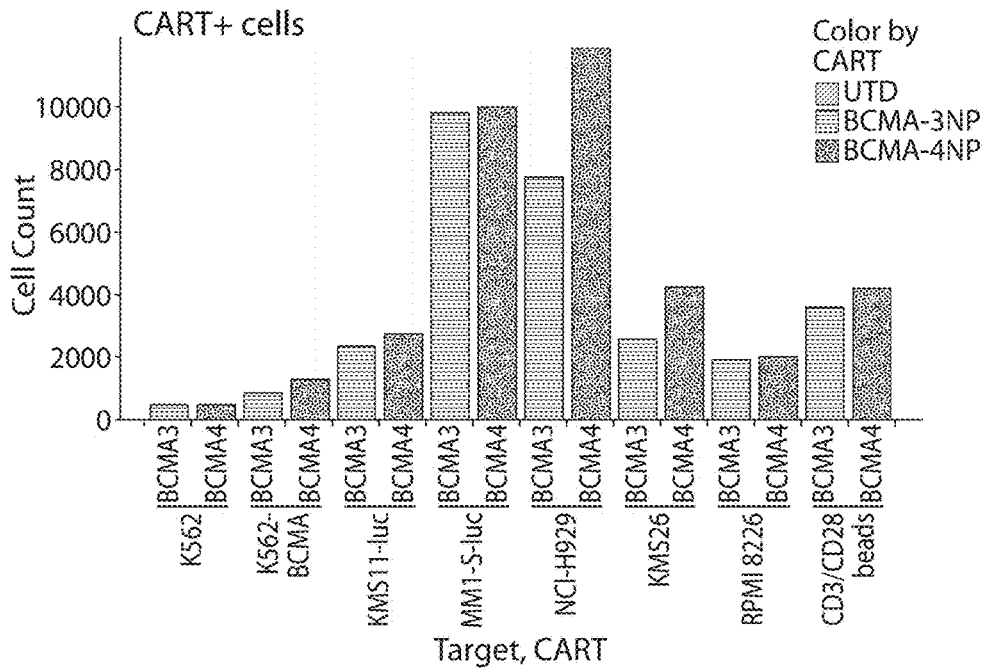
FIGS. 15A and 15B, are two graphs showing the proliferation of the tool BCMA CART cells by cell count (as measured by flow cytometry) for CART-expressing cells (FIG. 15A) and the total number of cells (FIG. 15B), after stimulation with the indicated target cells.
Figure 15B:
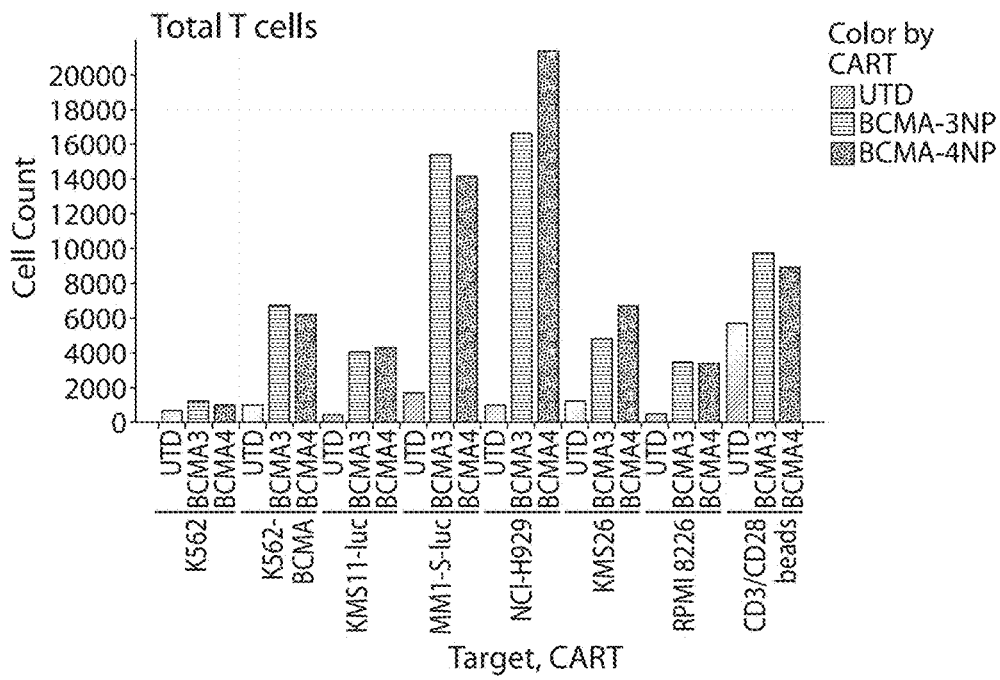

BCMA CART cell proliferation in response to BCMA-expressing target cells was evaluated. CART cells were thawed on Day 0 and incubated overnight to recover. On Day 1, CART cells were labeled with CellTrace CFSE (Life Technologies) and incubated with irradiated target cells at an E:T ratio of 1:1. Dynabeads Human T-Expander CD3/CD28 beads at a bead-to-cell ratio of 3:1 were included as a positive control. On Day 5, CFSE levels were measured in CART cells (FIG. 14). In addition, CART cells were stained with CD3, CD4, CD8, and BCMA-Fc antigen and measured by flow cytometry relative to CountBright Absolute Counting Beads (Life Technologies) to determine relative cell counts (FIGS. 15A-15B). Specific proliferation in response to BCMA observed for both BCMA-3NP and BCMA-4NP.

BCMA CART Luciferase Cell Killing Assay

BCMA CART cell killing in response to BCMA-expressing target cells was evaluated. CART cells were thawed on Day 0 and incubated overnight to recover. On Day 1, CART cells were incubated with either BCMA expressing KMS11-luciferase or MM1-S-luciferase target cells at E:T ratios ranging from 0 to 20. Loss of luciferase signal resulting from cell killing was measured using Bright-Glo substrate on Day 2 and specific lysis was calculated according to the following formula:

$$\text{Specific lysis (\%)} = 100 - (\text{sample luminescence/average maximal luminescence}) * 100$$

Figure 16:
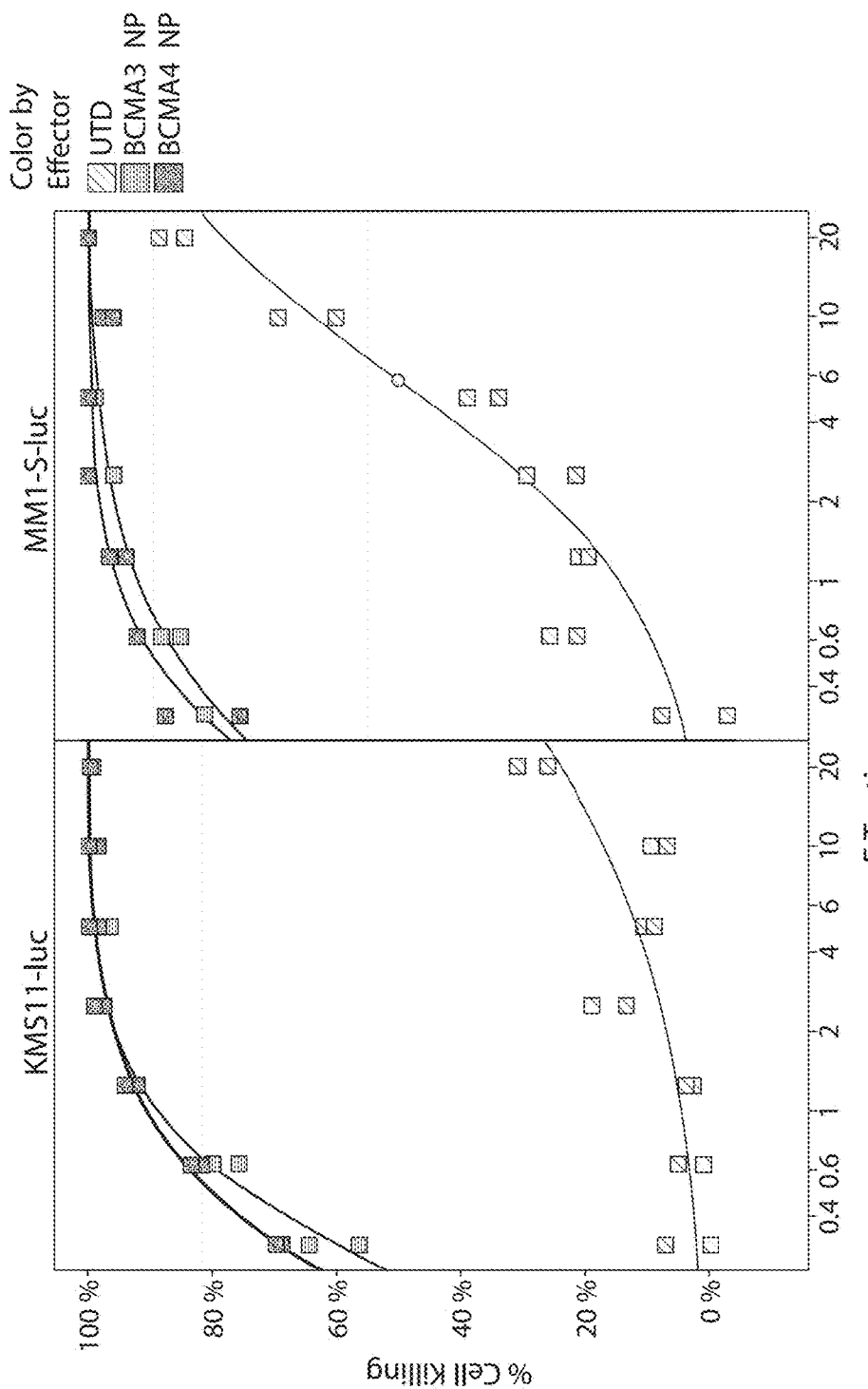
FIG. 16 is a graph showing the tool BCMA CART killing in response to BCMA-expressing target cells KMS11-luciferase cells (left) and MM1-S-luciferase cells (right) by luciferase assay.

Results of cell killing are showing in FIG. 16 demonstrating tool CART clones have specific killing response.

BCMA CART CFSE Cell Killing Assay

Figure 17:
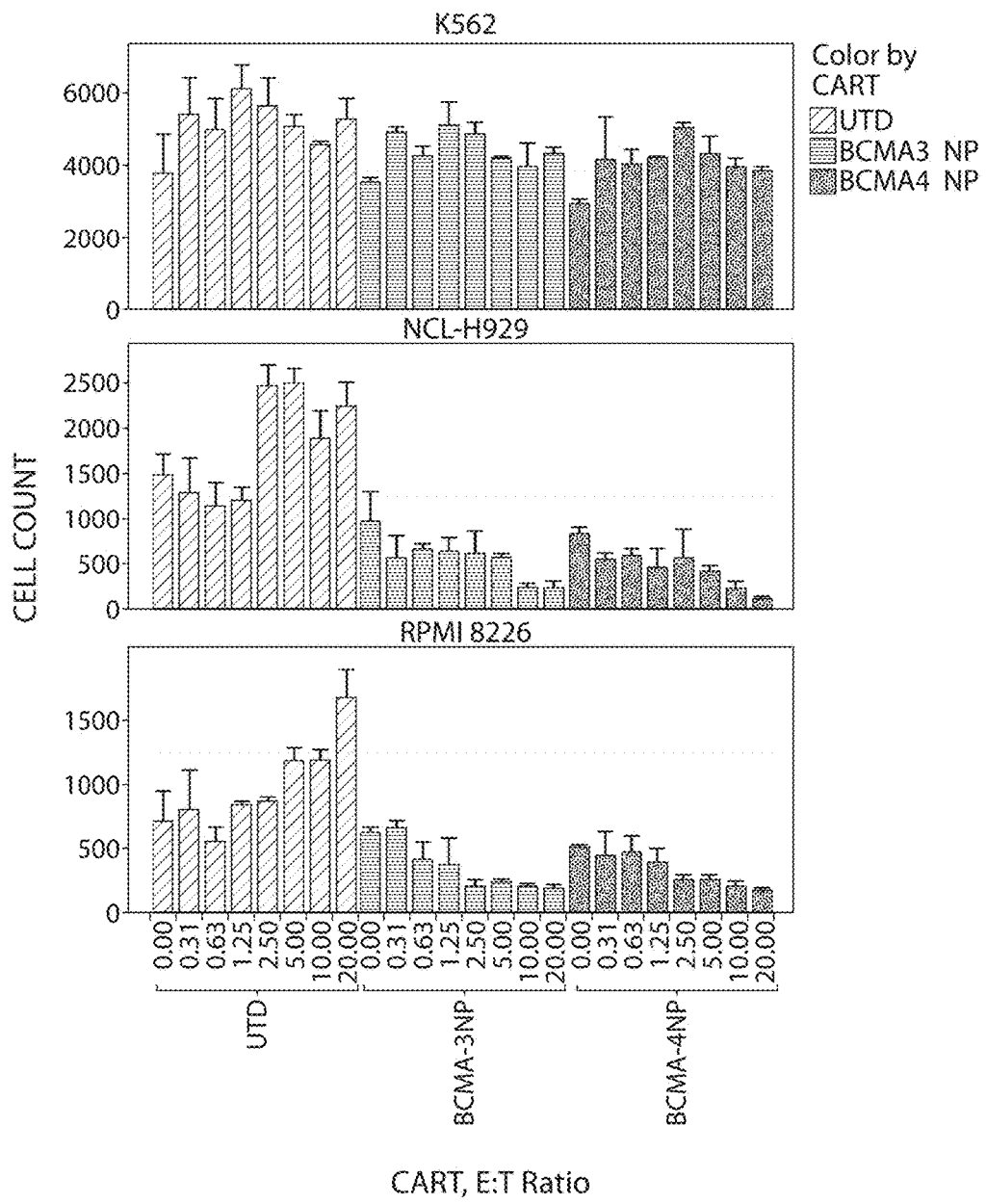
FIGS. 17A and 17B are a series of graphs showing tool BCMA CART killing in response to BCMA-expressing target cells by CFSE cell killing assay.
Figure 17:
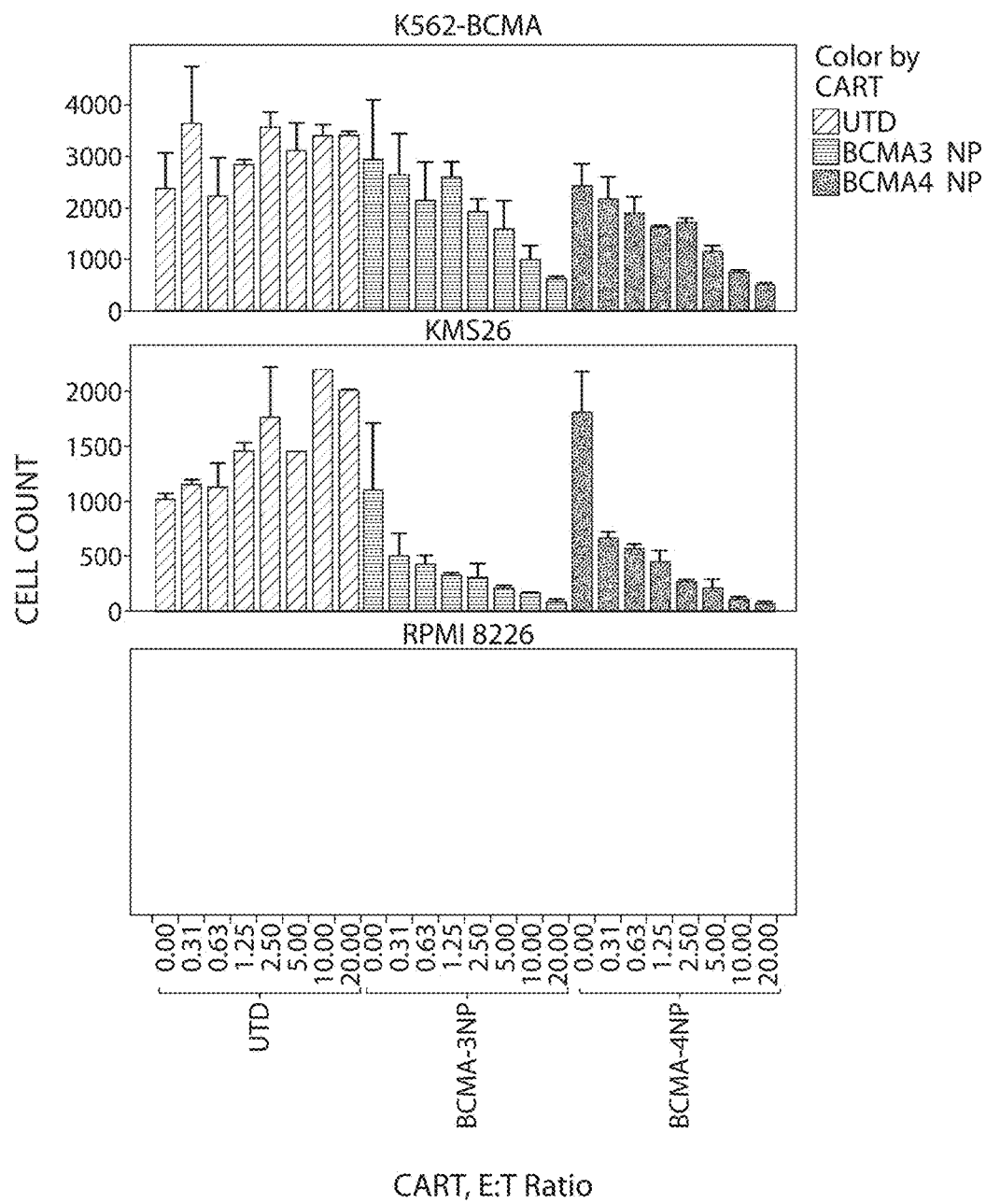

BCMA CART cell killing in response to BCMA-expressing target cells was evaluated. CART cells were thawed on Day 0 and incubated overnight to recover. On Day 1, target cells were labeled with CellTrace CFSE (Life Technologies) and incubated with BCMA CAR T cells at E:T ratios ranging from 0 to 10. Target cell lines were: K562-BCMA (engineered to stably express BCMA), K562 (parental line), and BCMA positive multiple myeloma cell lines, NCI-H929, KMS26, and RPMI 8226. Loss of CFSE-positive cells resulting from cell killing was measured on Day 2 by flow cytometry relative to CountBright Absolute Counting Beads (Life Technologies) to determine relative cell counts (FIGS. 17A-17B). Specific cell killing was observed for both BCMA-3NP and BCMA-4NP.

Based on in vitro characterization of BCMA tool CAR clones, BCMA-3NP and BCMA-4NP, were selected for in vivo evaluation in KMS11-luciferase disseminated tumor model. UTD (untransduced) T cells were selected as a negative control. The results from the in vivo characterization is further described in Example 5.

Example 6: In Vitro Characterization of BCMA CART

The experiments described in this example utilize CAR constructs containing human anti-BCMA scFvs from Table 8, and the tool BCMA CAR contructs.

JNL Reporter Assay for BCMA CAR Constructs

Figure 18:
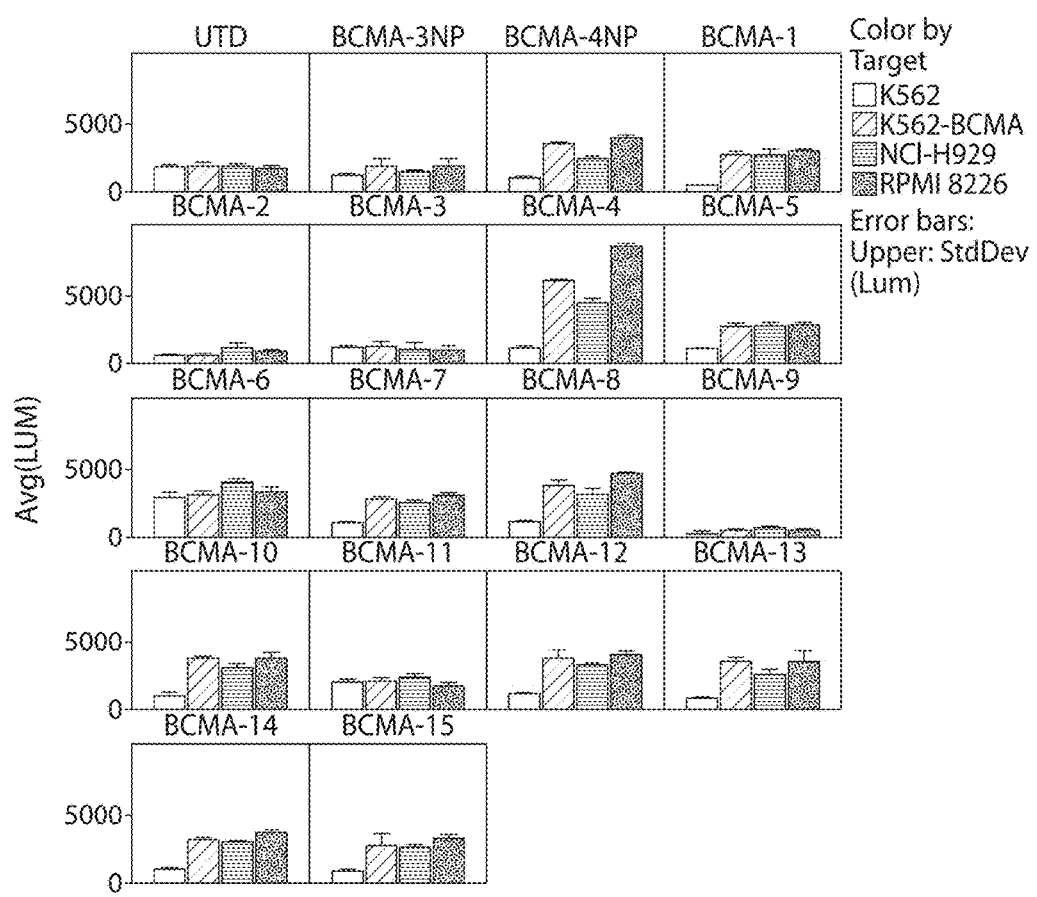
FIG. 18 is a series of graphs demonstrating target-specific activation of BCMA CARs containing human anti-BCMA scFvs tranduced in a reporter cell line by luciferase reporter assay.

Jurkat-NFAT-luciferase (JNL) cells transduced with BCMA CAR constructs were evaluated for activation in response to BCMA-expressing target cell lines. Small-scale viral supernatant samples were generated in HEK293T cells for transduction of JNL cells. On Day 3 following transduction, BCMA CAR-transduced JNL cells were incubated with target cells at an effector-to-target (E:T) ratio of 6:1. Target cell lines were: K562-BCMA (engineered to stably express BCMA), K562 (parental line), and BCMA positive multiple myeloma cell lines, NCI-H929 and RPMI 8226. JNL activation was measured using Bright-Glo substrate (Promega) on Day 4. CAR expression on transduced JNL was assessed on Day 7 with BCMA-Fc antigen and Biotin-Protein L reagent (Table 21). This reporter assay demonstrates that several BCMA-targeting CAR clones are activated in a target-specific manner (FIG. 18).

TABLE 21

Percent CAR expression on JNL cells

| Clone | BCMA-Fc detection % CAR+ |
|---|---|
| BCMA-1 | 72.1 |
| BCMA-2 | 32.0 |
| BCMA-3 | 0.0 |
| BCMA-4 | 49.5 |
| BCMA-5 | 28.9 |
| BCMA-6 | 44.4 |
| BCMA-7 | 30.4 |
| BCMA-8 | 32.4 |
| BCMA-9 | 54.7 |
| BCMA-10 | 29.5 |
| BCMA-11 | 42.7 |
| BCMA-12 | 23.4 |
| BCMA-13 | 32.7 |
| BCMA-14 | 31.8 |
| BCMA-15 | 36.9 |
| BCMA-3NP | 6.7 |
| BCMA-4NP | 28.3 |

JNL activity was not correlated with % CAR expression. Based on BCMA-specific activation, the following BCMA CAR clones were selected for characterization in primary T cells: BCMA-1, BCMA-4, BCMA-5, BCMA-7, BCMA-8, BCMA-10, BCMA-12, BCMA-13, BCMA-14, and BCMA-15. Based on the non-specific activation observed, BCMA-6 was selected as a negative control. Based on the absence of activity observed, BCMA-9 was also selected as a negative control.

BCMA CAR Transduction of Primary Human T Cells

Figure 19:
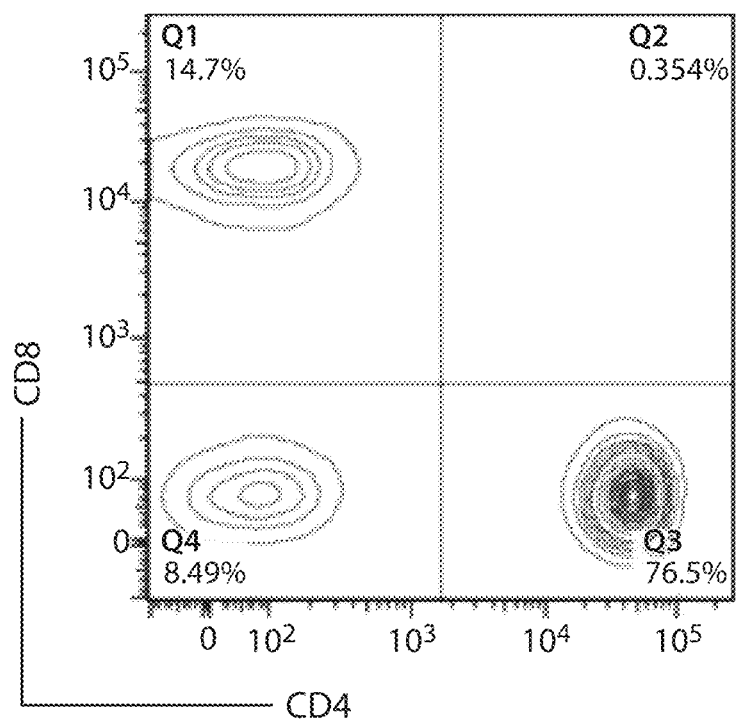
FIG. 19 is a flow cytometry plot showing the distribution of CD4+ and CD8+ T cell populations after CD3/CD28 expansion, and before CAR transduction.

Schedule for isolation, transduction and activation of primary T cells with BCMA-targeting CARs is shown in Table 22. On Day 0, healthy human donor PBMCs (Novartis Employee Blood Donor program) were isolated from whole blood by Ficoll extraction, and T cells were isolated from PBMC by negative selection using the Pan T Cell Isolation Kit II (Miltenyi Biotec). Isolated T cells were stimulated overnight with Dynabeads Human T-Expander CD3/CD28 beads (Life Technologies) at a 3:1 ratio of beads-to-cells. T cells were also stained to assess relative amounts of CD4+ and CD8+ cells (FIG. 19).

TABLE 22

Scedule for T cell expansion of BCMA CAR transduced clones

| Day # | Activity |
|---|---|
| 0 | Isolate and activate T cells |
| 1 | Transduce T cells (MOI = 5) |
| 2 | Add medium - 0.5 ml/well |
| 3 | |
| 4 | Split 1:3 |
| 5 | |
| 6 | Split 1:2 |
| 7 | |
| 8 | Split 1:2.25 |
| 9 | |
| 10 | |
| 11 | De-bead and freeze aliquots |

On Day 1, T cells were transduced with the following BCMA CAR clones: BCMA-1, BCMA-4, BCMA-5, BCMA-6, BCMA-7, BCMA-8, BCMA-9, BCMA-10, BCMA-12, BCMA-13, BCMA-14, BCMA-15, BCMA-3NP, and BCMA-4NP. Virus concentrations were adjusted to a MOI of 5 (Table 23) and incubated overnight.

TABLE 23

Calculation of T cells added per well for each clone to obtain an MOI of 5.

| Clone | TU/ml | MOI: 5 per well |
|---|---|---|
| BCMA-1 | 1.27E+08 | 39.4 |
| BCMA-4 | 1.46E+08 | 34.3 |
| BCMA-5 | 9.98E+07 | 50.1 |
| BCMA-6 | 1.41E+08 | 35.5 |
| BCMA-7 | 6.41E+07 | 78.0 |
| BCMA-8 | 6.15E+07 | 81.4 |
| BCMA-9 | 8.57E+07 | 58.3 |
| BCMA-10 | 6.73E+07 | 74.3 |
| BCMA-12 | 4.88E+07 | 102.5 |
| BCMA-13 | 9.96E+07 | 50.2 |
| BCMA-14 | 9.88E+07 | 50.6 |
| BCMA-15 | 7.39E+07 | 67.6 |
| BCMA-3NP | 5.38E+07 | 92.9 |
| BCMA-4NP | 5.35E+07 | 93.5 |

Figures 1, 20:
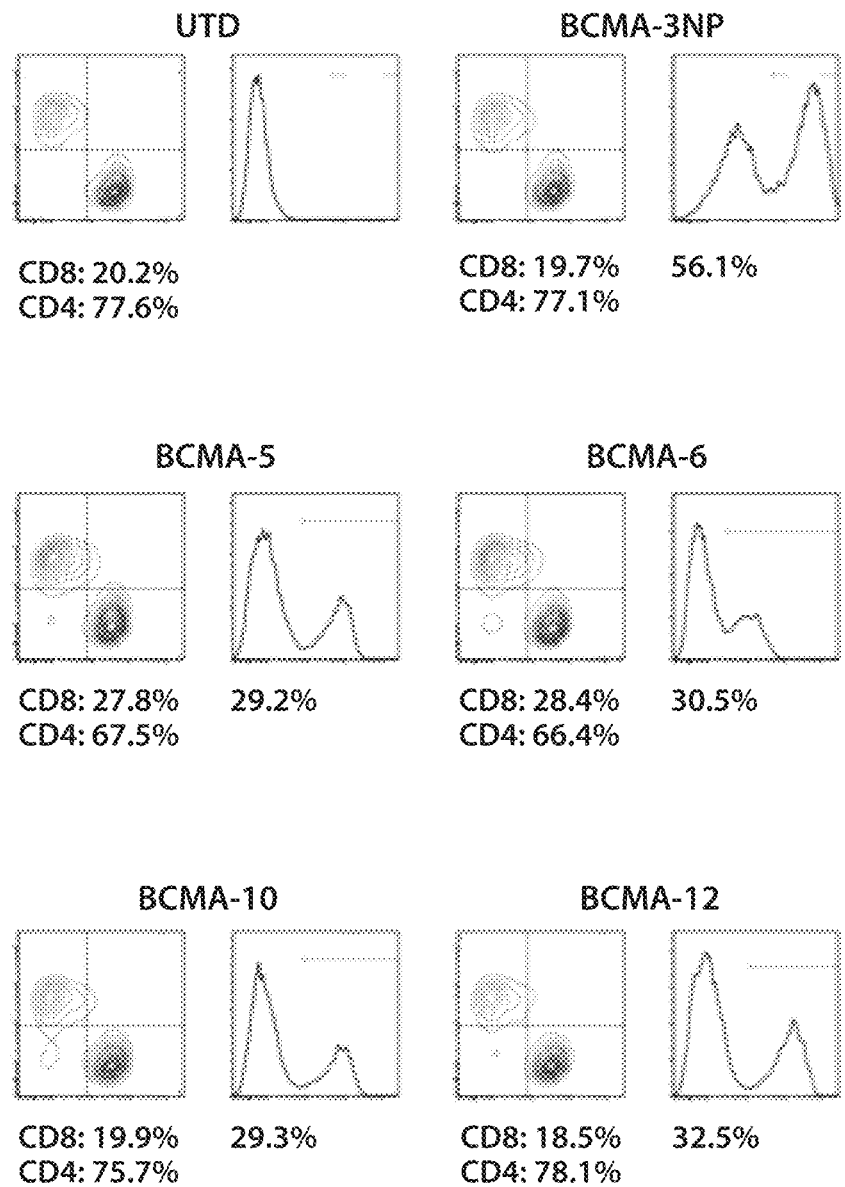
FIGS. 20A, 20B and 20C are a series of flow cytometry plots and corresponding histogram plots showing the transduction efficiency by assessing CAR expression on the transduced T cells.
Figures 2, 20:
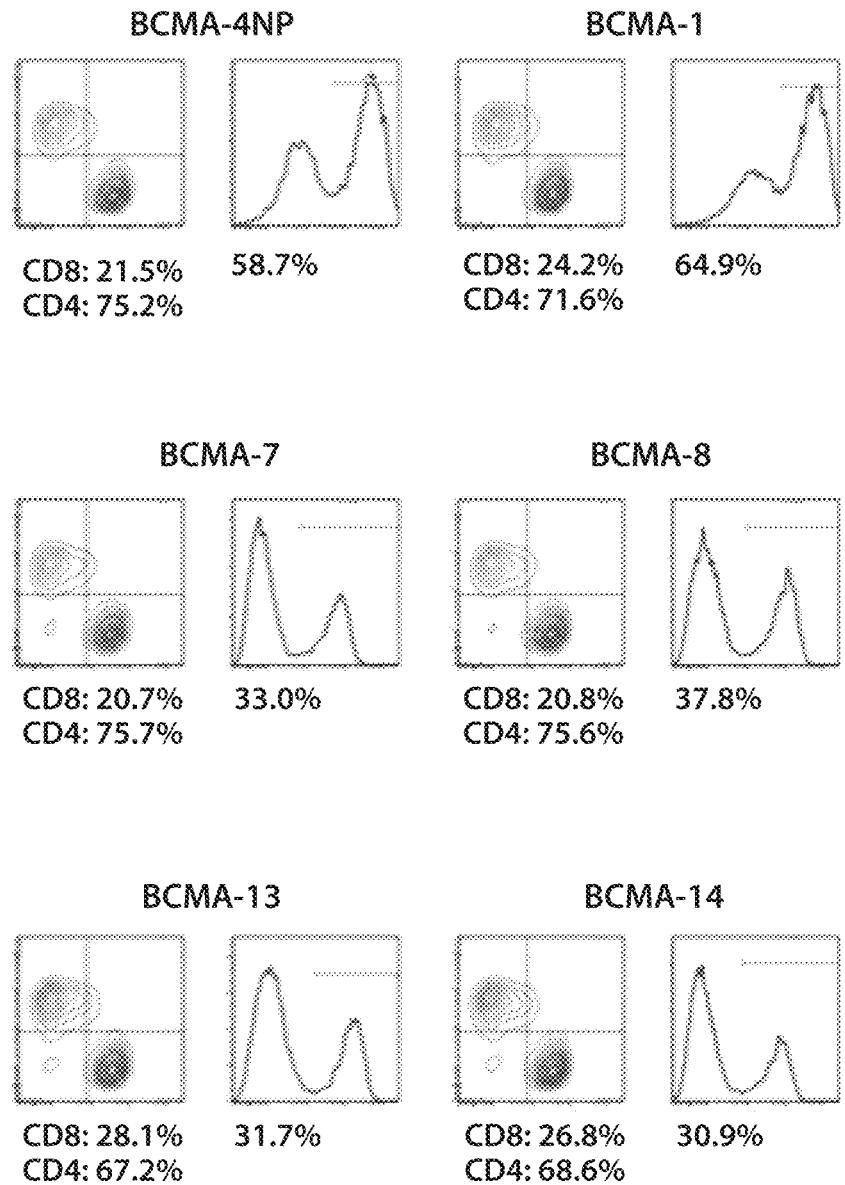

On Day 11, transduced CART cells were de-beaded and frozen in aliquots in 90% FBS, 10% DMSO. Following transduction and expansion, T cells were again stained to assess relative amounts of CD4+ and CD8+ cells. In addition, CAR expression was assessed with BCMA-Fc antigen (FIGS. 20A-20C).

BCMA CART Proliferation Assay

Figure 21:
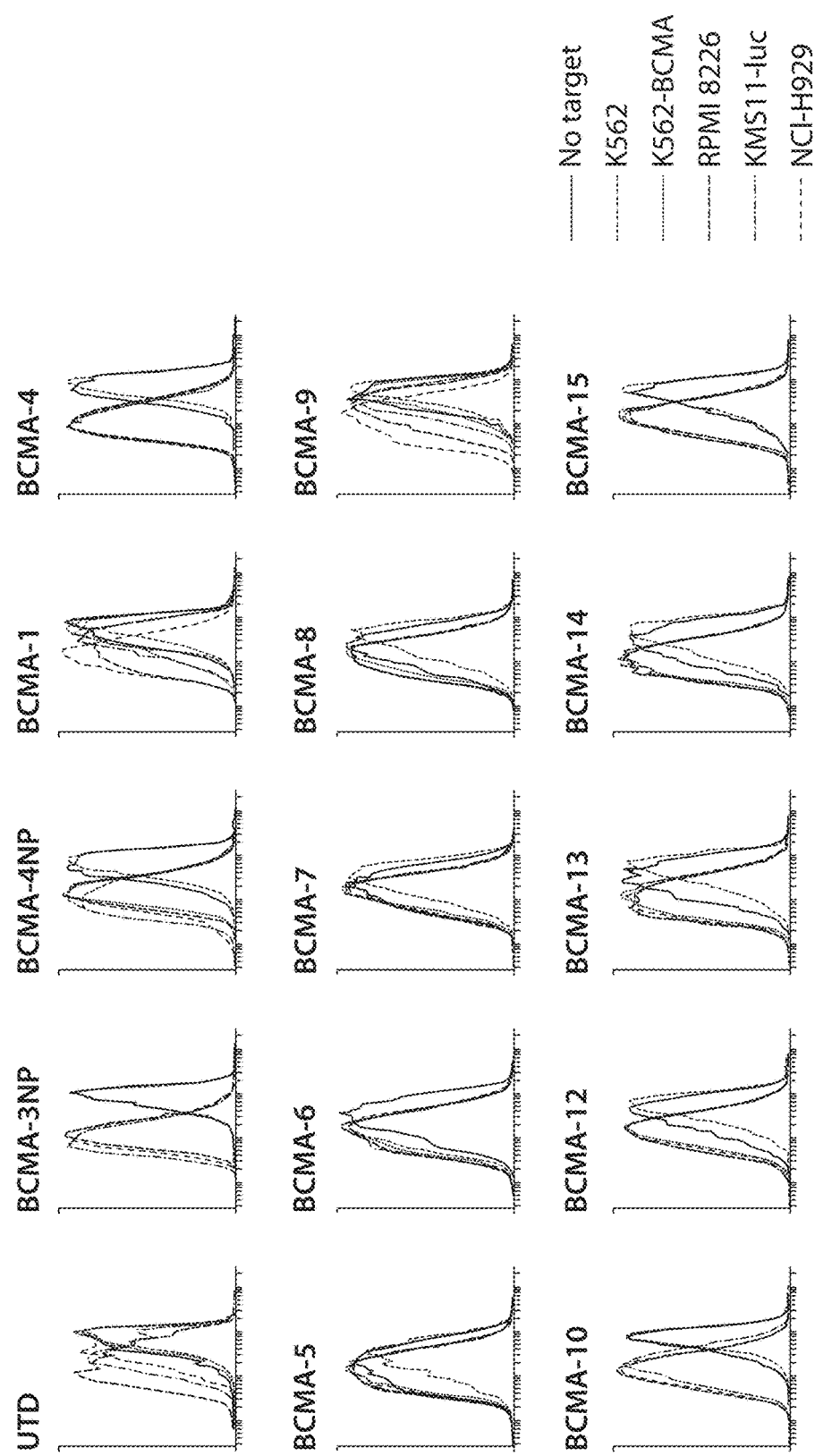
FIG. 21 is a series of histogram plots showing the cell proliferation of BCMA CART cells in response to stimulation with the indicated target cells (K562, K562 expressing BCMA, RPMI 8226, KM11-luc, and NCI-H929), as measured by CFSE staining.

BCMA CART cell proliferation in response to BCMA-expressing target cells was evaluated. CART cells were thawed on Day 0 and incubated overnight to recover. On Day 1, CART cells were labeled with CellTrace CFSE (Life Technologies) and incubated with irradiated target cells at an E:T ratio of 1:1. On Day 6, CFSE levels were measured in CART cells (FIG. 21).

Figure 22A:
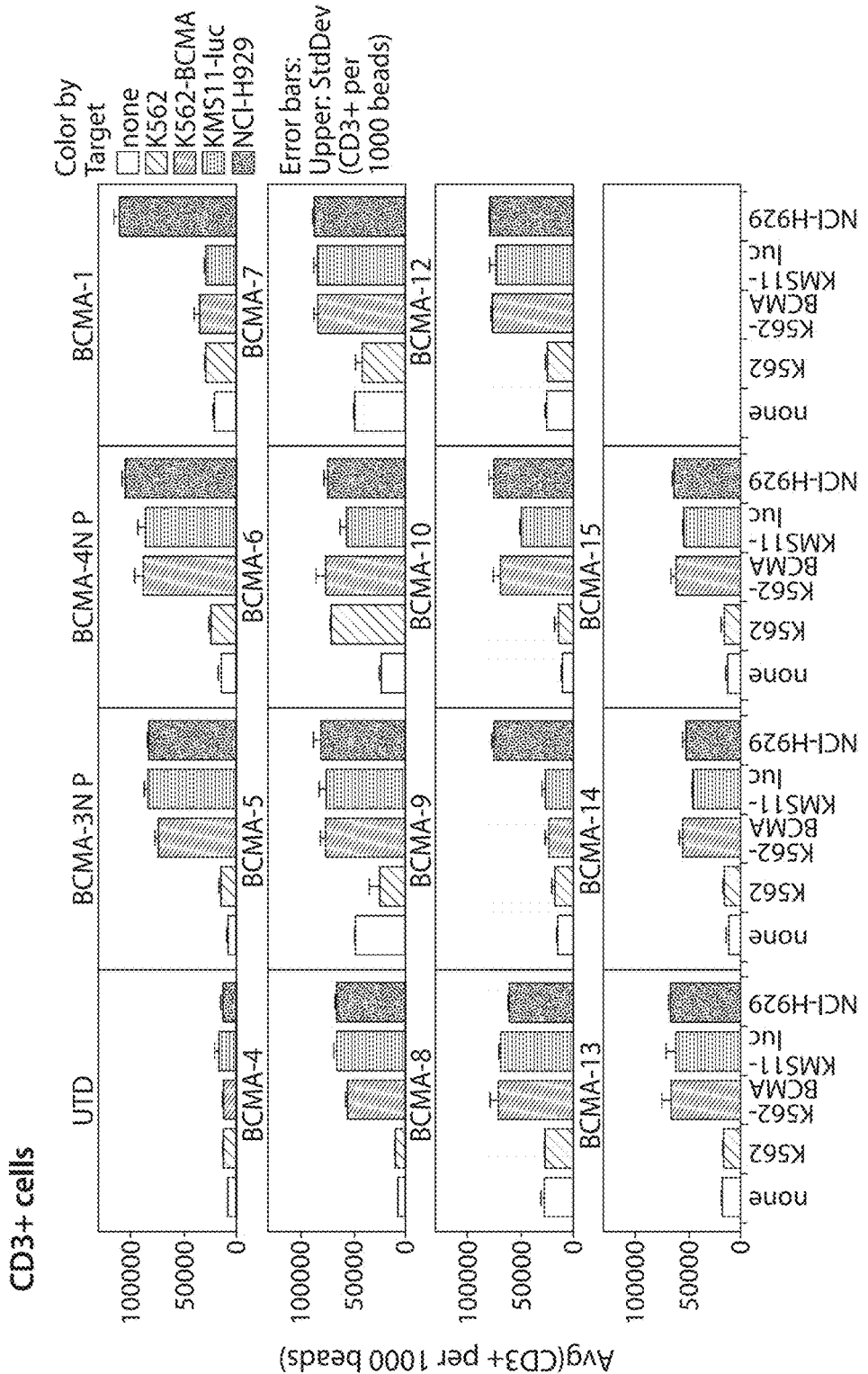
FIG. 22A, FIG. 22B, and FIG. 22C are a series of graphs that demonstrate BCMA CART cell proliferation in response to stimulation with the indicated target cells (K562, K562 expressing BCMA, RPMI 8226, KMS11-luc, and NCI-H929), as measured by flow cytometry analysis. Proliferation of the CART cells was independently analyzed for each T cell populations expressing CD3 (FIG. 22A), CD4 (FIG. 22B), and CD8 (FIG. 22C).
Figure 22B:
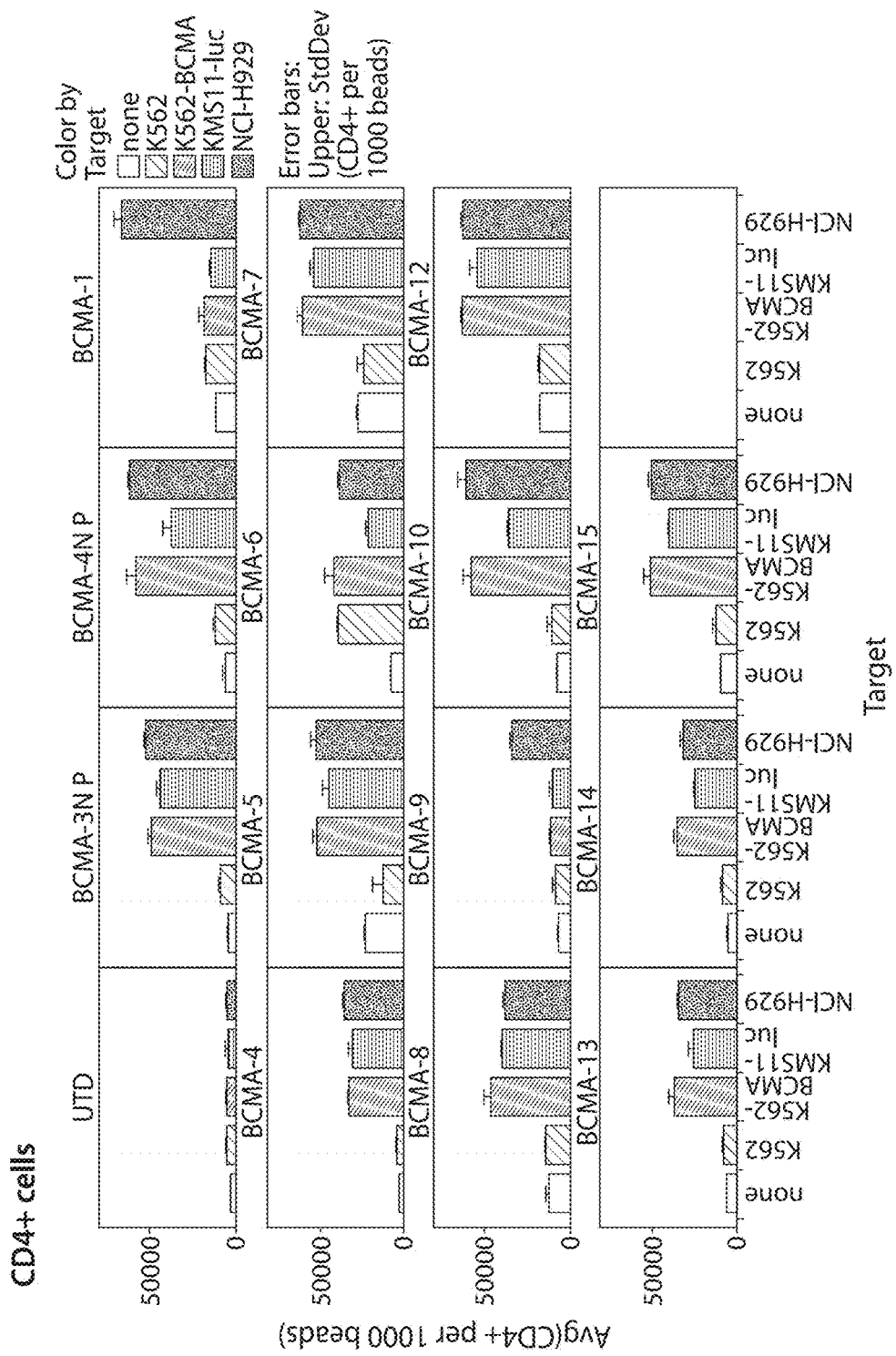
Figure 22C:
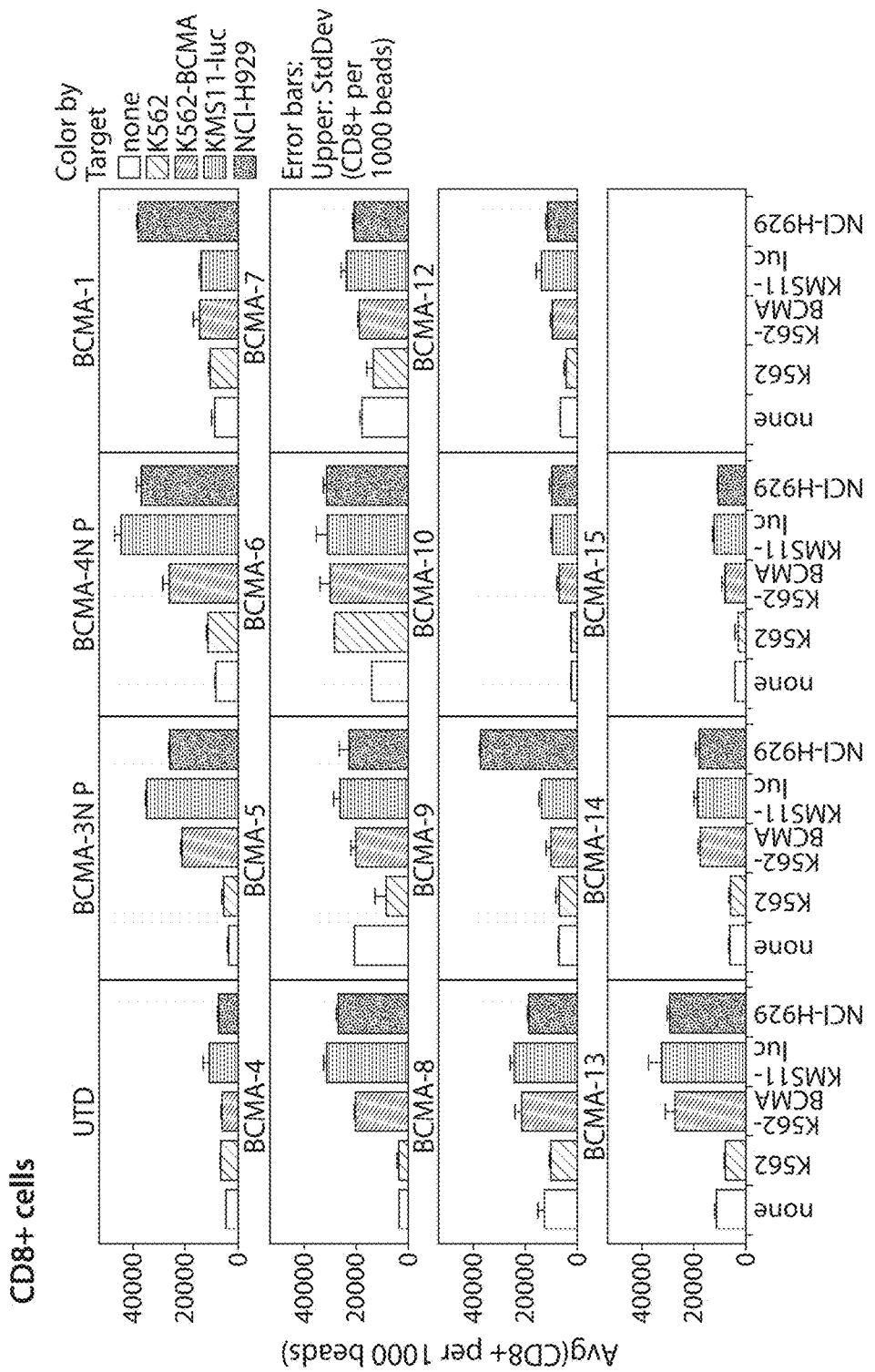

In addition, CART cells were stained with CD3, CD4, and CD8 and measured by flow cytometry relative to CountBright Absolute Counting Beads (Life Technologies) to determine relative cell counts (FIGS. 22A, 22B, and 22C). Specific proliferation in response to BCMA observed for the following CART clones: BCMA-4, BCMA-10, BCMA-12, BCMA-13, BCMA-14, and BCMA-15.

BCMA CART Killing Assay

BCMA CART cell killing in response to BCMA-expressing target cells was evaluated. CART cells were thawed on Day 0 and incubated overnight to recover. On Day 1, CART cells were incubated with BCMA expressing KMS11-luciferase target cells at E:T ratios ranging from 0 to 10. Loss of luciferase signal resulting from cell killing was measured using Bright-Glo substrate on Day 2 and specific lysis was calculated according to the following formula:

Specific lysis (%)=100−(sample luminescence/average maximal luminescence)*100

Figures 1, 23A:
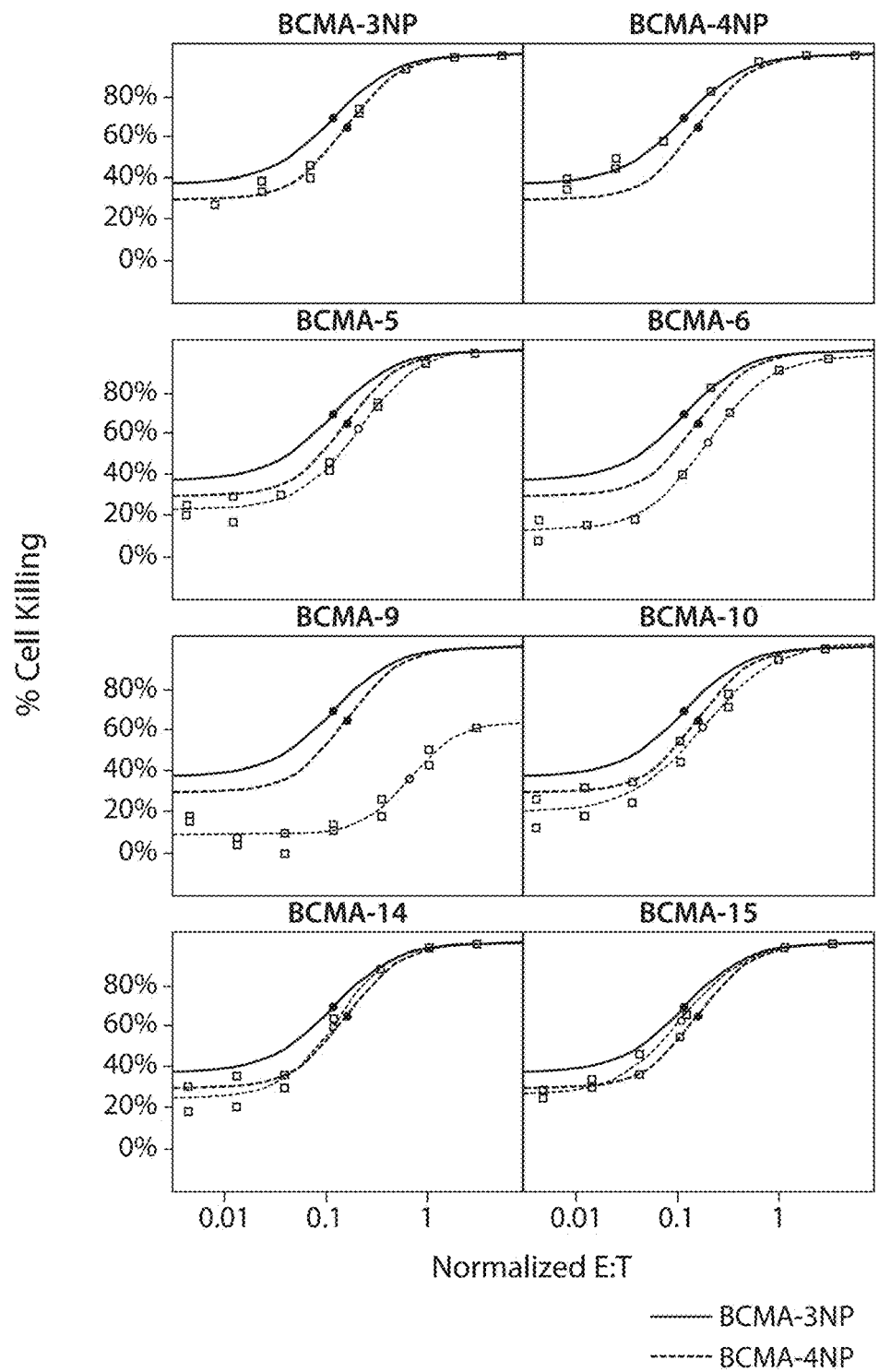
Figures 2, 23A:
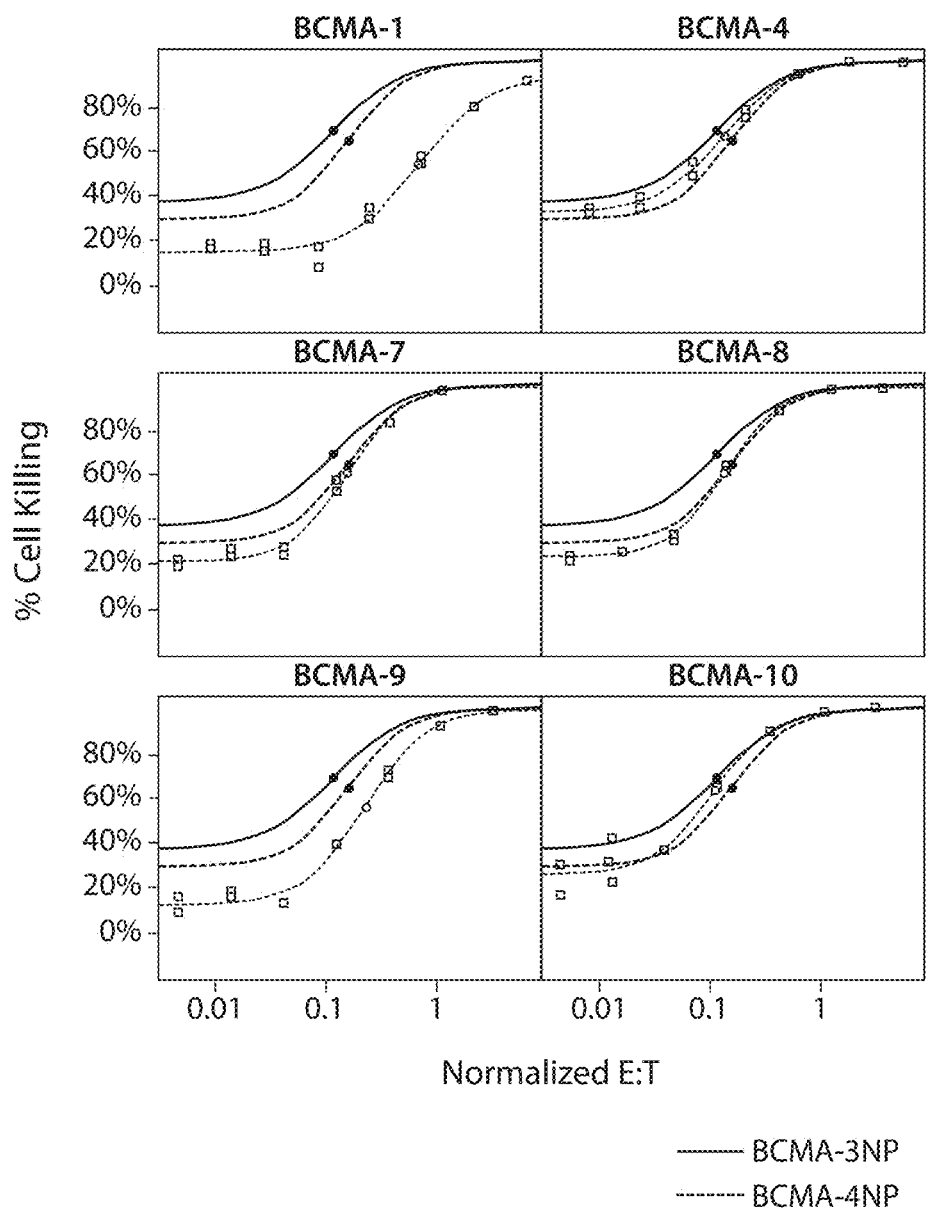
Figure 23B:
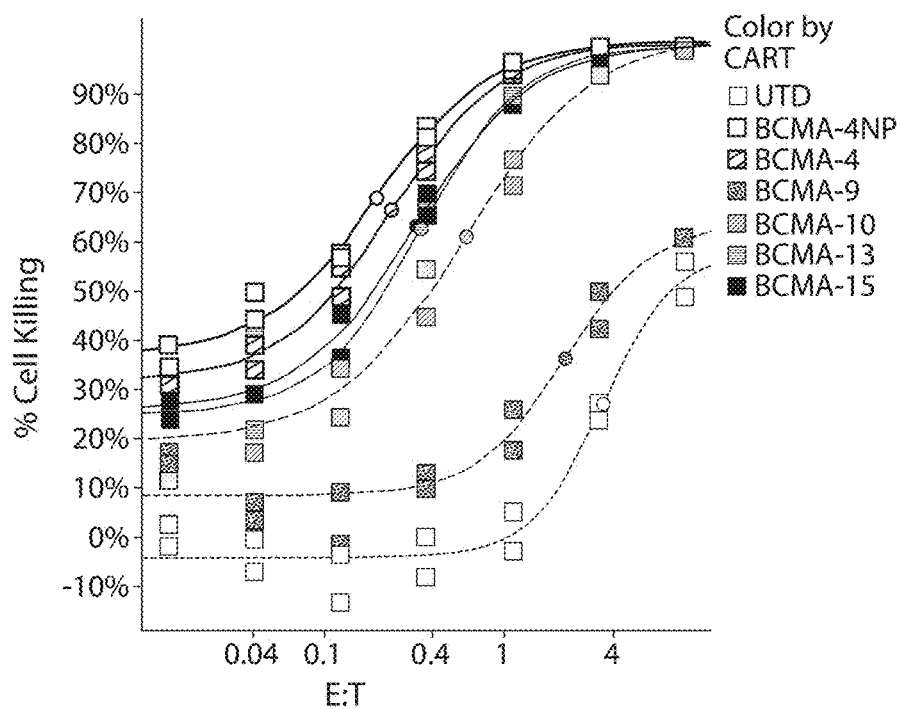
Figure 23C:
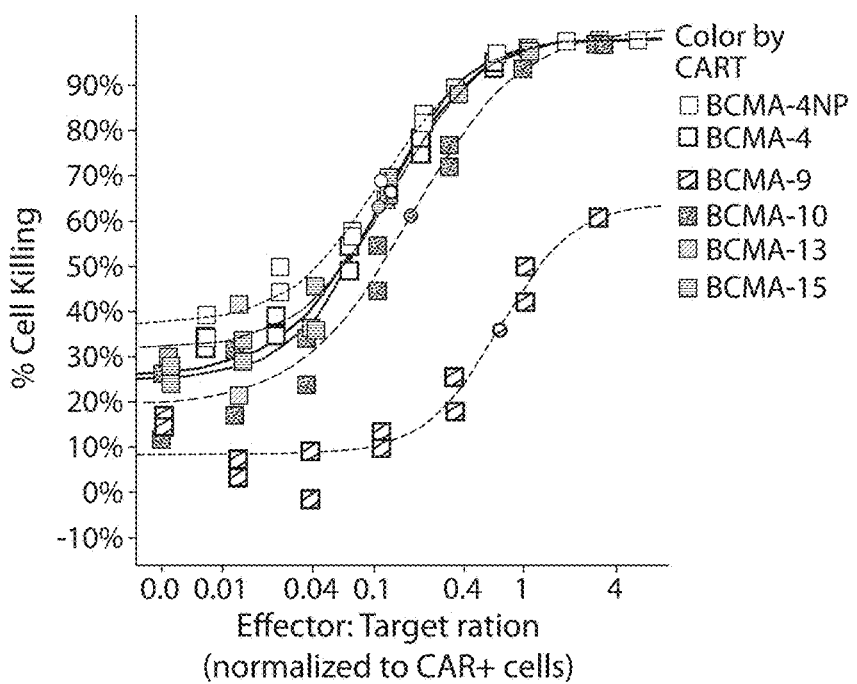

Results of the cell killing assay are shown in FIG. 23A-B, comparing each BCMA CAR construct to BCMA-3NP and BCMA-4NP. These results demonstrate that several CART clones (expressing the human anti-BCMA scFvs) have a greater killing response than the control BCMA-3NP and BCMA-4NP constructs. The results from select candidate BCMA CARs (BCMA-4, BCMA-9, BCMA-10, BCMA-13, and BCMA-15) are presented in graph in FIG. 23C to compare the killing capacity between the candidate CARs. Untransduced T cells and T cells transduced with BCMA-4NP construct were used as negative and positive controls, respectively. The percentage of cell killing of the select BCMA CART clones (BCMA-4, BCMA-9, BCMA-10, BCMA-13, and BCMA-15) were normalized to the percent of CAR expression for each CART and presented in FIG. 23D. The results show that BCMA-4, BCMA-9, BCMA-10, BCMA-13, and BCMA-15 CART clones all had cell killing capacity similar to that of BCMA-4NP.

A summary of the in vitro assays of BCMA CART clones described above is shown in Table 24. Based on the in vitro characterization of BCMA CART clones, BCMA-4, BCMA-10, BCMA-13, and BCMA-15 were selected for in vivo evaluation in KMS11-luciferase disseminated tumor model, as described in Example 7. BCMA-4NP was selected a positive control. BCMA-9 and UTD (untransduced) were selected as negative controls.

Example 7: In Vivo Characterization of BCMA CART

KMS-11 is a human multiple myeloma cell line derived from an IgGκ pleural effusion, and can be grown as a xenograft in immune compromised mice. This xenograft will mimic disease in the bone marrow as seen in humans, establishing a model with which to test the efficacy of therapies on multiple myeloma in the bone. These mice can be used to test the efficacy of chimeric antigen receptor (CAR) T cells specific for cellular markers found on plasma cells and multiple myeloma cells, such as the B Cell Maturation Antigen (BCMA). KMS-11 cells were tagged with a firefly luciferase reporter gene and used in an orthotopic model of multiple myeloma in NOD.Cg-Prkdc$^{scid}$Il2rg$^{tm1Wjl}$/SzJ (NSG) mice to test the efficacy of CAR T cells specific for BCMA.

BCMA expression was tested on KMS-11 cells and these cells were used in in vitro assays to look at the ability of BCMA-specific CAR T cells to recognize and respond to the target. In vivo KMS-11 cells grow when implanted intravenously via the tail vein and growth is limited primarily to the bone marrow. One week after the tumor cells are implanted, the disease shifts fully to the bones and begins to grow at an exponential rate. Left untreated, mice will start to display clinical symptoms and hind limb paralysis 5-6 weeks after

TABLE 24

Summary of in vitro characterization of BCMA CART clones

| | JNL binding assay Ratio to K562 | | | Cell Killing | Proliferation CD3 Ratio to no target | | | | | |
|---|---|---|---|---|---|---|---|---|---|---|
| | K562-BCMA | NCI-H929 | RPMI 8226 | EC50 KMS11-luc | K562 | K562-BCMA | NCI-H929 | KMS11-luc | RPMI 8226 | |
| BCMA-3NP | 1.58 | 1.30 | 1.58 | 0.16 | 1.70 | 7.96 | 8.91 | 8.96 | 8.43 | BCMA-3NP |
| BCMA-4NP | 3.15 | 2.27 | 3.54 | 0.12 | 1.58 | 5.52 | 6.52 | 5.41 | 5.83 | BCMA-4NP |
| BCMA-1 | 4.60 | 4.55 | 5.06 | 0.68 | 1.38 | 1.59 | 4.97 | 1.38 | 2.96 | BCMA-1 |
| BCMA-4 | 4.47 | 3.31 | 6.25 | 0.13 | 1.34 | 7.37 | 8.64 | 8.63 | 8.14 | BCMA-4 |
| BCMA-5 | 2.34 | 2.34 | 2.40 | 0.21 | 0.52 | 1.62 | 1.72 | 1.61 | 1.73 | BCMA-5 |
| BCMA-6 | 1.07 | 1.38 | 1.16 | 0.20 | 2.94 | 3.14 | 3.09 | 2.35 | 3.17 | BCMA-6 |
| BCMA-7 | 2.55 | 2.36 | 2.77 | 0.15 | 0.84 | 1.72 | 1.80 | 1.71 | 1.62 | BCMA-7 |
| BCMA-8 | 3.17 | 2.67 | 3.87 | 0.14 | 0.98 | 2.55 | 2.17 | 2.46 | 2.56 | BCMA-8 |
| BCMA-9 | 1.59 | 1.99 | 1.54 | 0.68 | 1.19 | 1.51 | 4.63 | 1.66 | 2.50 | BCMA-9 |
| BCMA-10 | 3.23 | 2.70 | 3.25 | 0.18 | 1.31 | 5.84 | 6.37 | 4.20 | 6.69 | BCMA-10 |
| BCMA-12 | 3.17 | 2.78 | 3.36 | 0.22 | 0.95 | 2.90 | 2.98 | 2.76 | 3.27 | BCMA-12 |
| BCMA-13 | 3.74 | 2.68 | 3.66 | 0.11 | 0.93 | 3.47 | 3.46 | 3.20 | 3.48 | BCMA-13 |
| BCMA-14 | 2.81 | 2.65 | 3.31 | 0.12 | 1.24 | 4.12 | 3.86 | 3.42 | 3.93 | BCMA-14 |
| BCMA-15 | 2.91 | 2.79 | 3.49 | 0.11 | 1.13 | 3.94 | 4.08 | 3.51 | 3.73 | BCMA-15 |

| | Proliferation | | | | | | | | |
|---|---|---|---|---|---|---|---|---|---|
| | CD8 Ratio to no target | | | | CD4 Ratio to no target | | | | |
| K562 | K562 BCMA | NCI-H929 | KMS11-luc | RPMI 8226 | K562 | K562 BCMA | NCI-H929 | KMS11-luc | RPMI 8226 | |
| 1.54 | 5.79 | 7.05 | 9.41 | 5.90 | 1.76 | 9.42 | 10.02 | 8.46 | 10.02 | BCMA-3NP |
| 1.34 | 3.06 | 4.31 | 5.20 | 3.49 | 1.85 | 8.50 | 8.98 | 5.54 | 8.50 | BCMA-4NP |
| 1.18 | 1.61 | 4.14 | 1.56 | 3.58 | 1.51 | 1.57 | 5.57 | 1.24 | 2.43 | BCMA-1 |
| 1.18 | 5.66 | 7.42 | 8.74 | 6.19 | 1.50 | 9.21 | 9.86 | 8.60 | 10.12 | BCMA-4 |
| 0.04 | 0.99 | 1.11 | 1.27 | 1.25 | 0.57 | 2.19 | 2.23 | 1.90 | 2.15 | BCMA-5 |
| 2.01 | 2.13 | 2.26 | 2.23 | 2.39 | 4.39 | 4.70 | 4.34 | 2.50 | 4.35 | BCMA-6 |
| 0.77 | 1.08 | 1.18 | 1.35 | 1.19 | 0.89 | 2.17 | 2.23 | 1.96 | 1.91 | BCMA-7 |
| 0.81 | 1.59 | 1.41 | 1.83 | 1.81 | 1.15 | 3.59 | 2.98 | 3.11 | 3.33 | BCMA-8 |
| 1.05 | 1.43 | 4.79 | 1.83 | 2.76 | 1.31 | 1.59 | 4.45 | 1.49 | 2.24 | BCMA-9 |
| 1.03 | 3.01 | 3.86 | 3.84 | 4.33 | 1.37 | 6.40 | 7.05 | 4.25 | 7.31 | BCMA-10 |
| 0.72 | 1.51 | 1.76 | 2.11 | 2.12 | 1.02 | 3.42 | 3.41 | 2.94 | 3.66 | BCMA-12 |
| 0.72 | 234 | 2.53 | 2.79 | 2.86 | 1.28 | 5.40 | 5.05 | 3.84 | 4.44 | BCMA-13 |
| 1.00 | 2.65 | 2.73 | 2.83 | 3.03 | 1.49 | 5.73 | 5.07 | 3.97 | 4.84 | BCMA-14 |
| 0.84 | 1.89 | 2.42 | 2.73 | 2.51 | 1.26 | 4.87 | 4.82 | 3.82 | 4.24 | BCMA-15 | tumor implantation. Tool BCMA CAR T cells were first tested in this model in an efficacy study to determine if the model is an appropriate in vivo model to test the efficacy and anti-tumor activity of BCMA CAR T cells. Following this, lead BCMA scFvs from an in vitro screen have been tested in this in vivo model and are now being confirmed in a repeat efficacy study.

Materials and Methods:

KMS-11 Cell Line:

The KMS-11 human multiple myeloma cell line was developed from the pleural effusion of a patient with multiple myeloma. The cells were then tagged with firefly luciferase. These suspension cells grow in RPMI supplemented with 10% heat inactivated fetal bovine serum.

Mice:

6 week old NSG (NOD.Cg-Prkdc$^{scid}$Il2rg$^{tm1Wjl}$/SzJ) mice were received from the Jackson Laboratory (stock number 005557). Animals were allowed to acclimate to the Novartis NIBRI animal facility for at least 3 days prior to experimentation. Animals were handled in accordance with Novartis ACUC regulations and guidelines.

Tumor Implantation:

KMS-11-luc cells were grown and expanded in vitro in RPMI supplemented with 10% heat inactivated fetal bovine serum. The cells were then transferred to a 15 ml conical tube and washed twice with cold sterile PBS. KMS-11-luc cells were then counted and resuspended at a concentration of $10 \times 10^6$ cells per milliliter of PBS. The cells were placed on ice and immediately (within one hour) implanted in the mice. KMS-11 cells were injected intravenously via the tail vein in a 100 µl volume, for a total of $1 \times 10^6$ cells per mouse.

CAR T Cell Dosing:

Mice were administered $5 \times 10^6$ T cells 7-8 days after tumor implantation. Cells were partially thawed in a 37 degree Celsius water bath and then completely thawed by the addition of 1 ml of cold sterile PBS to the tube containing the cells. The thawed cells were transferred to a 15 ml falcon tube and adjusted to a final volume of 10 mls with PBS. The cells were washed twice at 1000 rpm for 10 minutes each time and then counted on a hemocytometer. The CAR T cells were normalized for CAR transduction so that each group has the same percentage of CAR$^+$ T cells. The total of the $5 \times 10^6$ cells were then resuspended at a concentration of $50 \times 10^6$ cells per ml of cold PBS and kept on ice until the mice were dosed. The mice were injected intravenously via the tail vein with 100 µl of the CAR T cells for a dose of $5 \times 10^6$ T cells per mouse.

Five to seven mice per group were treated either with 100 µl of PBS alone (PBS), untransduced T cells (Mock), tool BCMA CAR T cells (BCMA-3NP or BCMA-4NP), or novel BCMA CAR T cells (BCMA-4, BCMA-9, BCMA-10, BCMA-13, BCMA-15). The T cells were all prepared from the same human donor in parallel.

Animal Monitoring:

The health status of the mice was monitored daily, including twice weekly body weight measurements. The percent change in body weight was calculated as $(BW_{current} - BW_{initial})/(BW_{initial}) \times 100\%$. Tumor burden was monitored twice weekly by bioluminescent imaging. Mice were intraperitoneally injected with D-luciferin 10 minutes prior to anesthetizing and imaging the mice with a Xenogen. Disease burden was calculated by calculating the bioluminescence of the tumor cells (photons/second).

Bioluminescence Analysis:

Percent treatment/control (T/C) values were calculated using the following formula:

% $T/C = 100 \times \Delta T/\Delta C$ if $\Delta T \geq 0$;

% Regression $= 100 \times \Delta T/T_{initial}$ if $\Delta T < 0$;

where T=mean bioluminescence of the drug-treated group on the final day of the study; $T_{initial}$=mean bioluminescence of the drug-treated group on initial day of dosing; $\Delta T$=mean bioluminescence of the drug-treated group on the final day of the study -=mean bioluminescence of the drug treated group on the initial day of dosing; C=mean bioluminescence of the control group on the final day of the study; and $\Delta C$=mean bioluminescence of the control group on the final day of the study -=mean bioluminescence of the control group on the initial day of dosing.

T/C values in the range of 100% to 42% are interpreted to have no or minimal anti-tumor activity; T/C values that are ≤42% and >10% are interpreted to have anti-tumor activity or tumor growth inhibition. T/C values ≤10% or regression values ≥−10% are interpreted to be tumor stasis. Regression values <−10% are reported as regression.

Peripheral Blood FACS Analysis:

T cells in the peripheral blood of the mice were also monitored. Mice were bled weekly via the tail vein into EDTA coated tubes that were kept on ice. 10-20 µl of blood was plated from the tubes into 96 well plates on ice. Red blood cells were lysed with ACK red blood cell lysis buffer (Life Technologies, catalog number A10492-01) and then washed twice with cold PBS. The cells were incubated with an Fc blocking mix of human and mouse Fc block (Miltenyi Biotec, catalog numbers 130-059-901 and 130-092-575) for 30 minutes and then incubated with anti-mouse CD11b antibody (BD Biosciences, catalog number 557960), anti-human CD4 antibody (BD Biosciences catalog number 563550), anti-human CD8 antibody (BD Biosciences catalog number 560347), and BCMA-Fc antibody (R&D Systems, catalog number 193-BC-050), followed by an Ig secondary (Jackson ImmunoResearch). The cells were fixed with a 2% paraformaldehyde solution for 20 minutes, washed and stored in PBS+2% FBS overnight prior to analysis on a BD Fortessa, followed by further analysis using the FlowJo FACS analysis software. The cells were analyzed to determine the number of CAR$^+$ CD4$^+$ and CD8$^+$ T cells per milliliter of blood in the KMS-11-luc tumor-bearing NSG mice. T cell numbers in the blood are reported as the mean±standard error of the mean (SEM).

Results:

The anti-tumor activity of the tool BCMA CAR T cells (BCMA-3NP and BCMA 4-NP) were evaluated and directly compared in the KMS-11 model of human multiple myeloma. Following tumor implantation on day 0, mice were randomized into treatment groups and treated with $5 \times 10^6$ T cells intravenously on day 7. Multiple myeloma disease burden and animal health were monitored until animals achieved endpoint. The mice in all the groups were euthanized on day 14 post-CAR T cell dosing (day 21 post-tumor implantation) when disease burden in the control groups nearing maximum luminescence via imaging.

A clear difference in disease burden can be seen between the control groups and the groups treated with either of the tool CAR T cells with P<0.01 on day 14 post-CAR T cell dosing. Both of the tool BCMA CAR T cells demonstrate a similar ability to control human multiple myeloma growth in NSG mice. The % T/C value for the mock transduced T cell group is 212.13%, demonstrating that the mock transduced T cells have no anti-tumor activity.

Figure 24:
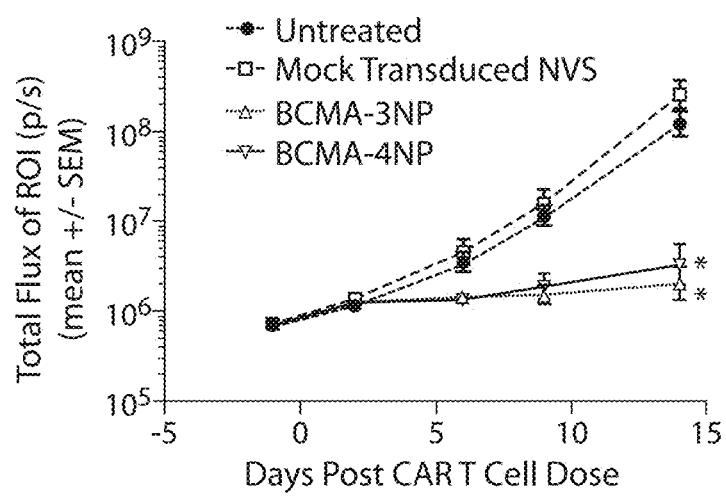
FIG. 24 is a graph showing that treatment with BCMA CARTs results in control of disease progression in the KMS-11-luc human multiple myeloma xenograft in NSG mice. Mean bioluminescence (+/−SEM) of the tumor cells shows the disease burden in the whole animal, as represented in the graph as photons/second (p/s) of the ROI (region of interest, e.g., the whole mouse). Significance calculated by ANOVA versus the vehicle; * denotes P<0.01.

The percent delta T/C values for the BCMA-3NP and BCMA-4P groups are 1.10% and 2.17% respectively, demonstrating tumor stasis after treatment with the tool BCMA CAR T cells. The bioluminescence imaging results are shown in FIG. 24. The PBS treatment group, which did not receive any T cells, demonstrates baseline KMS-11 tumor growth kinetics in intravenously implanted NSG mice. The Mock treatment group received untransduced T cells that underwent the same in vitro expansion process as the CAR T cells. These cells serve as a T cell control to show the non-specific response of the T cells in this tumor model. Both the PBS and Mock transduced T cell treatment groups demonstrate continuous tumor progression throughout the experiment. Both the tool BCMA CAR T cells control the progression of disease after the $5 \times 10^6$ T cell injections.

Following confirmation that the KMS-11-luc model responds to targeting via BCMA CAR T cells, a study to evaluate novel scFv leads was initiated. Following tumor implantation, mice were again randomized into treatment groups and treated with $5 \times 10^6$ T cells intravenously on day 7. Multiple myeloma disease burden and animal health were monitored until animals achieved endpoint. The mice in each of the groups were euthanized when disease burden in the group neared maximum luminescence via imaging.

Figure 25A:
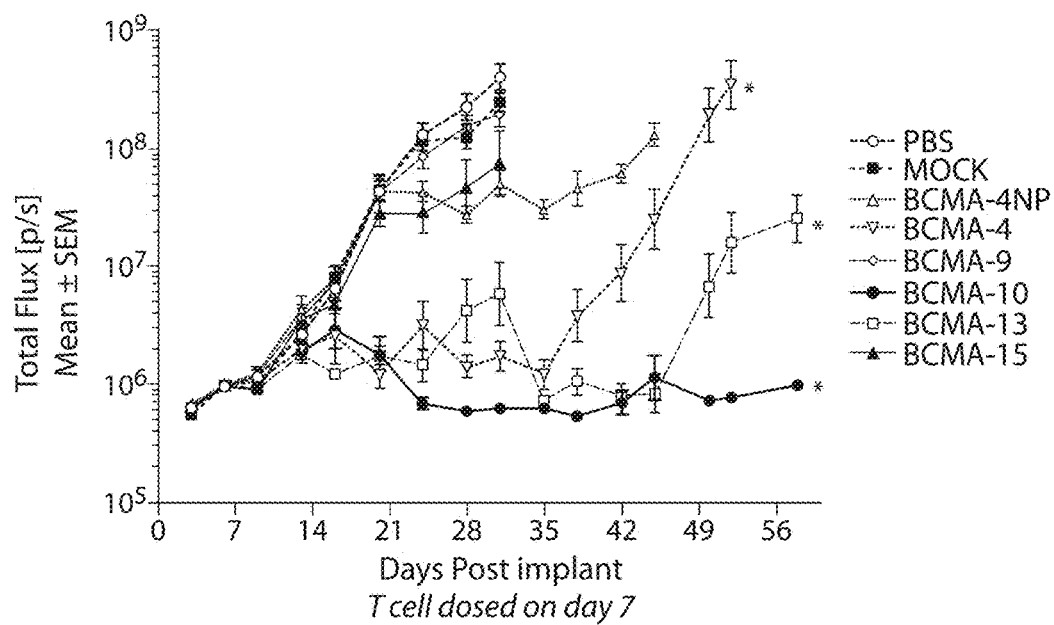
FIGS. 25A and 25B are two graphs demonstrating anti-tumor activity of BCMA CAR T cells in the KMS-11 human multiple myeloma model in two independent experiments. Mean bioluminescence (+/−SEM) of the tumor cells shows the disease burden in the whole animal, represented in the graph as photons/second (p/s) (or total flux or BLI) of the whole mouse. Significance calculated by ANOVA versus the vehicle on day 28; * denotes P<0.01 in FIG. 25A.

A clear difference in disease burden can be seen between the control groups and some of the groups treated with the BCMA CAR T cells. The tool BCMA CAR T cells (BMCA-4NP) did not control the KMS-11 tumor growth as they had been shown to do so previously. However, some of the novel BCMA CAR T cells did show varying levels of efficacy in this multiple myeloma model. The % T/C values calculated at the endpoint for each group show stasis in tumor growth for the BCMA-10 and BCMA-13 groups. The mock transduced T cell group has a % T/C value of 61.56%, demonstrating that the mock transduced T cells have minimal to no anti-tumor activity. The percent delta T/C values for the BCMA-4P group is 32.03%, demonstrating some minimal anti-tumor efficacy after treatment with the tool BCMA CAR T cells. Both the BCMA-10 and BCMA-13 groups show stasis in tumor growth with T/C values of 0.07% and 6.04% respectively. The BCMA-4 shows an initial control in tumor growth, but with only one T cell dose given to each group, the tumors in this group start to grow out. The bioluminescence imaging results from a first experiment are shown in FIG. 25A. The PBS treatment group, which did not receive any T cells, demonstrates baseline KMS-11 tumor growth kinetics in intravenously implanted NSG mice. The Mock treatment group received untransduced T cells that underwent the same in vitro expansion process as the CAR T cells. These cells serve as a T cell control to show the non-specific response of the T cells in this tumor model. Both the PBS and Mock transduced T cell treatment groups demonstrate continuous tumor progression throughout the experiment. Among the BCMA CAR T cell groups, BCMA-4, BCMA-10, and BCMA-13 show anti-tumor activity, while the tool BCMA CAR T cells (BCMA-4NP) and BCMA-9 and BCMA-15 show no anti-tumor efficacy. A second experiment was performed and the bioluminescence imaging results are provided in FIG. 25B. Mice receiving untransduced T cells show the baseline KMS-11 tumor growth kinetics. BCMA-4NP* represents the results from the BCMA-4NP CART clones in the first experiment. In the second experiment, BCMA-10, BCMA-13, and BCMA-15 showed robust anti-tumor activity.

In addition to monitoring the disease burden via bioluminescence, the CAR$^+$ T cell numbers in each group was also monitored vial peripheral blood FACS analysis. The FACS results of this study are shown in FIGS. 26A-26D. The groups that show anti-tumor effects on the KMS-11 tumors also show CD4$^+$ CAR$^+$ and CD8$^+$ CAR$^+$ T cells expanding in the peripheral blood. The BCMA-4, BCMA-10, and BCMA-13 groups show a peak of CD4$^+$ CAR$^+$ proliferation between days 10 and 20 post T cell treatment. These same groups also show a prolonged CD8$^+$ CAR$^+$ T cell expansion.

Figure 25B:
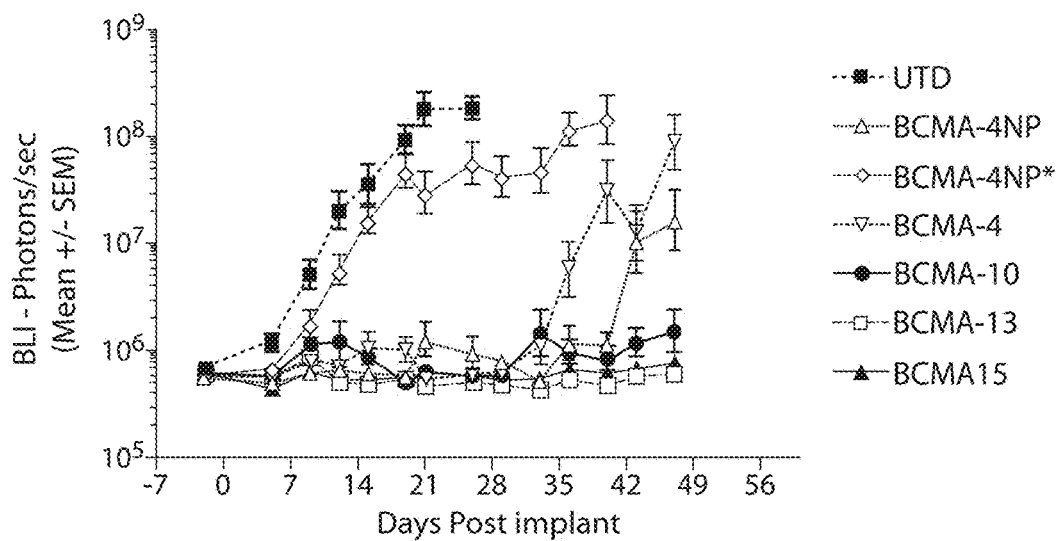

The anti-tumor activity of novel BCMA CAR transduced T cells was assessed in an efficacy study in NSG mice bearing a xenograft model of human multiple myeloma. These studies show that the KMS-11-luc model recapitulates human multiple myeloma in the NSG mouse and is capable of being targeted by BCMA CAR T cells (FIG. 24). Following the confirmation that this model is suitable to test BCMA CAR T cells, novel human BCMA CARs were tested in an efficacy study. This study demonstrated that several of the novel BCMA CARs (BCMA-4, BCMA-10, and BCMA-13) mounted an anti-tumor response in a xenograft model of multiple myeloma (FIG. 25A). The tumor experiment was repeated, testing BCMA-4, BCMA-10, BCMA-13, and BCMA-15. BCMA-4, BCMA-10, BCMA-13, and BCMA-15 demonstrated anti-tumor efficacy by inhibiting or reducing tumor growth for at least 4 weeks (28 days) after implantation (FIG. 25B).

Figure 26A:
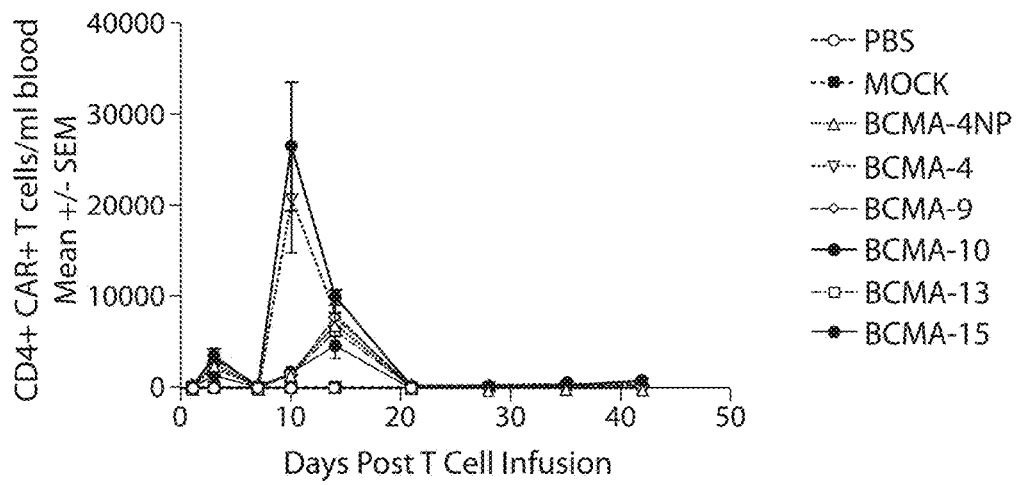
FIGS. 26A, 26B, 26C, and 26D are graphs showing the proliferation of BCMA-CART cells by quantification of BCMA-CART cell number in the peripheral blood of KMS-11-luc tumor-bearing mice. Peripheral blood T cells were analyzed on days 1, 3, 7, 10, 14 and weekly thereafter following CAR T cell treatment. From the first tumor experiment (results shown in FIG. 25A), the CD4+ CART population was assessed in FIG. 26A and the CD8+ CART population was assessed in FIG. 26B. From the second tumor experiment (results shown in FIG. 25B), the CD4+ CART population was assessed in FIG. 26C and the CD8+ CART population was assessed in FIG. 26D.
Figure 26B:
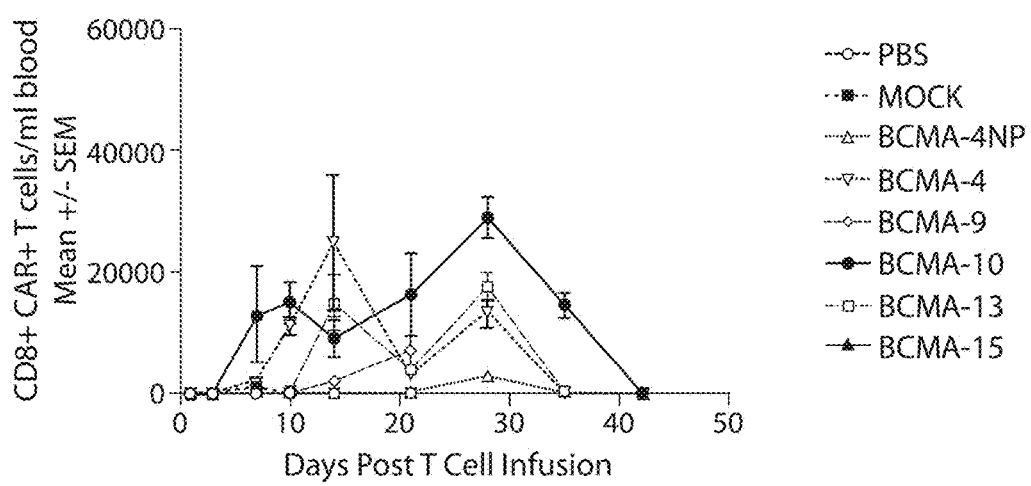
Figure 26C:
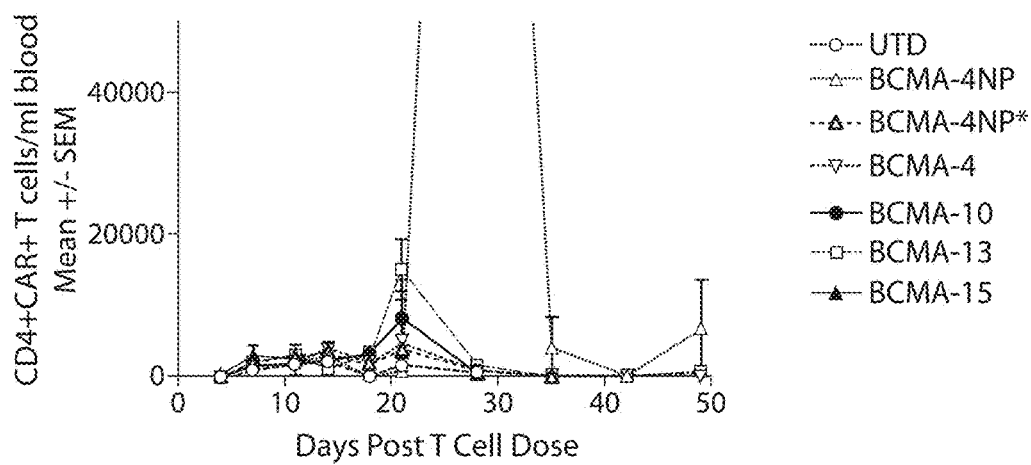
Figure 26D:
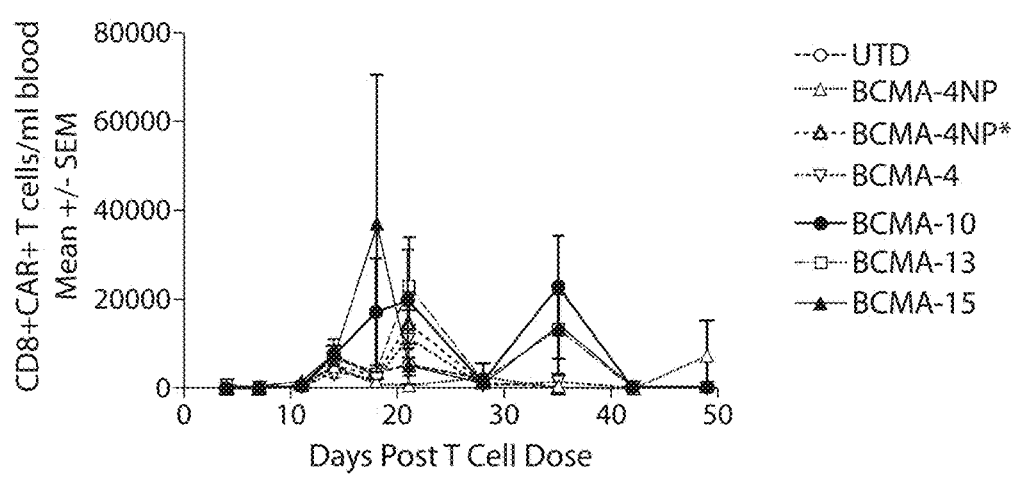

In addition, the anti-tumor response correlates with the expansion of CD4$^+$ CAR$^+$ and CD8$^+$ CAR$^+$ T cells in the peripheral blood of these mice (FIGS. 26A, B, C, and D). No anti-tumor efficacy was observed for any of the BCMA CARs when this T cell expansion is not observed. BCMA-10, which shows the greatest anti-tumor efficacy in this model, also shows the most sustained CD8$^+$ CAR$^+$ T cell expansion. The BCMA-4, BCMA-10 and BCMA-13 groups all show a significant change in tumor growth as compared to the control groups. The lack of efficacy seen with the tool BCMA CAR (BCMA-4NP) and BCMA-9 and BCMA-15 in the first tumor experiment (FIG. 25A) correlates with a lack of T cell expansion in the peripheral blood in the mice in these groups. Similarly, the lack of efficacy seen with BCMA-4NP in the second tumor experiment (FIG. 25B) correlates with the lack of T cell expansion in the peripheral blood in the mice.

Figure 27A:
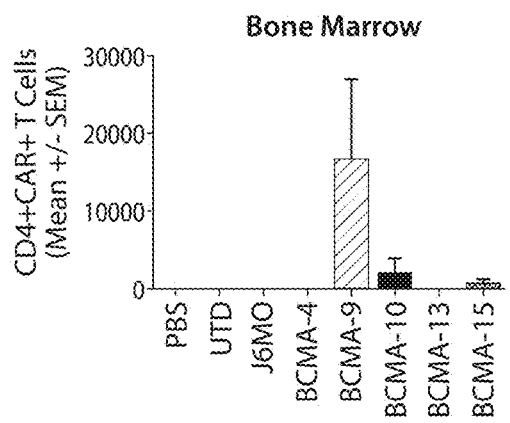
FIGS. 27A, 27B, 27C, and 27D are graphs showing the expansion of BCMA CAR-expressing T cells in the bone marrow and spleen at the end of the first tumor experiment (results shown in FIG. 25A). The average number of CD4+ BCMA CAR-expressing T cells in the bone marrow (FIG. 27A) and the spleen (FIG. 27B) was calculated. The average number of CD4=8+ BCMA CAR-expressing T cells in the bone marrow (FIG. 27C) and the spleen (FIG. 27D) was calculated. J6MO sample represents CAR T cells expressing the BCMA-4NP CAR construct.
Figure 27B:
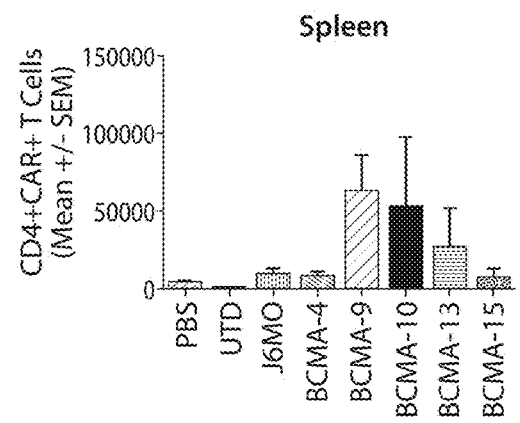
Figure 27C:
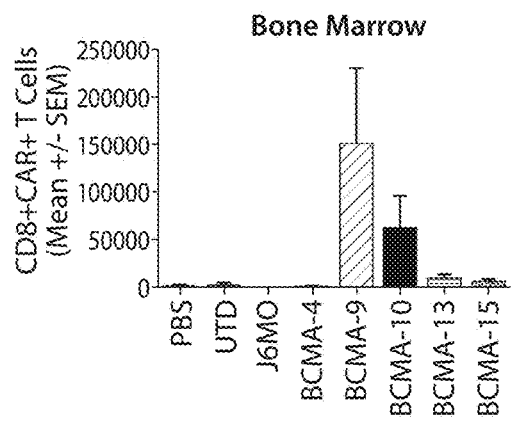
Figure 27D:
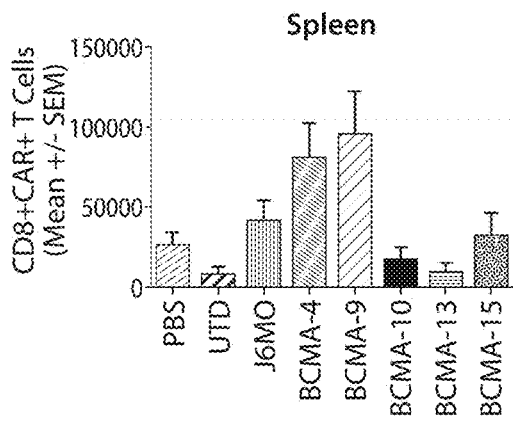

Terminal bone marrow and spleen samples were also analyzed at the end of the in vivo tumor experiment to determine if the CART clones that demonstrated anti-tumor efficacy show a difference in being able to establish a bone marrow population compared to the groups that did not show anti-tumor efficacy. The number of CAR-expressing CD4+ and CD8+ T cells was determined in the bone marrow (FIGS. 27A and 27C) and the spleen (FIGS. 27B and 27D) of the mice from the first experiment. The results show that administration of BCMA-9 CART resulted in the highest number of CAR+ T cells (both CD4+ and CD8+ T cells) in the bone marrow and spleen, indicating that BCMA-9 CART cells undergo efficient expansion in vivo, but does not have killing capacity, or anti-tumor activity. BCMA-10 CART cells showed the next most consistent establishment of T cells in the bone marrow and spleen. BCMA-4 and BCMA-15 CART cells were also found in the spleen.

Example 8: Identifying Lead BCMA CAR Constructs for Therapy

To identify the lead BCMA CAR constructs, the results of several in vitro and in vivo assays. The experimental assays, the Examples in which the details of the assays are described, and the number of lead BCMA CARs resulting after analysis of the assay are summarized in the following table (Table 25). The results of the assays were analyzed in the order as listed in Table 25 to select the candidate BCMA CARs that exhibited specificity, expression in immune effector cells, and in vitro and/or in vivo activity.

TABLE 25

Assays for selecting BCMA CARs

| Assay | Example where assay is described | Criteria | BCMA CARs (out of 15) |
|---|---|---|---|
| CAR expression (Jurkat and/or primary T cells lentivirally transduced) | Examples 5 and 6 | Yes | 14 |
| JNL NFAT reporter activation | Example 5 | >2-fold over negative control | 10 |
| T-cell expansion (Cell size, total cell count) | Examples 5 and 6 | Size: 10 microns Cell count: >20-fold over T = 0 cell number | 10 |
| T-cell proliferation (CFSE stained cells FACS) | | ≥1 log shift relative to negative control | 10 |
| Target cell killing (CFSE or luciferase) | Examples 5 and 6 | >90% killing at E:T 3-fold < negative control | 7 |
| Tumor regression (single dose administration; 1.5 × 10$^6$ CAR+ T cells) | Example 7 | Sustained tumor regression > 2 weeks Evidence of CAR+ T cell expansion | 4 or 2 |
| Lentiviral titer | Example 8 | Reproducibly high viral titers | 4 or 2 |

Based on in vitro assays, e.g., lentivirally transduced CAR expression, JNL NFAT activation, T cell expansion, T cell proliferation, and target cell killing (as described in Examples 5, 6 and 7), 7 BCMA CARs were identified as lead CARs to be tested for therapeutic efficacy in vivo, and 5 BCMA CARs (BCMA-4, BCMA-9, BCMA-10, BCMA-13, and BCMA-15) were tested in Example 8. As described in Example 8, BCMA-4, BCMA-10, BCMA-13, and BCMA-15 all demonstrated anti-tumor efficacy, with BCMA-10 and BCMA-13 reproducibly demonstrating anti-tumor efficacy in two separate in vivo experiments.

Figure 28A:
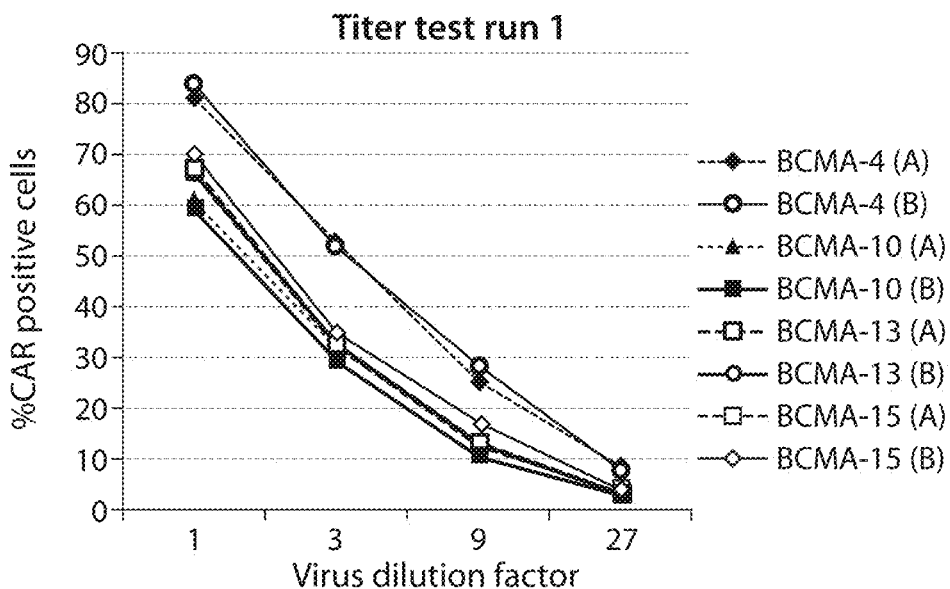
FIGS. 28A and 28B are graphs showing the lentiviral titer for select BCMA CAR constructs in two independent lentiviral experiments. In the first test run, two different DNA preps of the BCMA CAR constructs were tested (A and B) (FIG. 28A). In the second test run, three different DNA preps of the BCMA CAR constructs were tested (A, B, and C) (FIG. 28B).
Figure 28B:
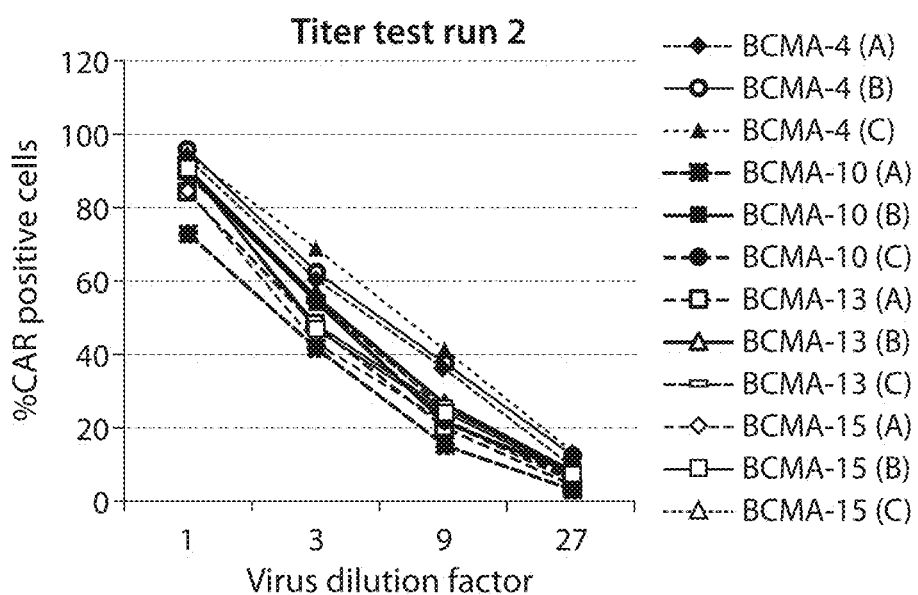

Lentiviral titer was compared between the candidate BCMA CARs after automated viral production and automated transduction of SupT1 cells. Two independent lentiviral titer assays were run. The first titer test run analyzed two independent DNA preps (A and B) of BMCA-4, BCMA-10, BCMA-13, and BCMA-15 CARs. The second titer test run analyzed three independent DNA preps (A, B and C) of BMCA-4, BCMA-10, BCMA-13, and BCMA-15 CARs. Viral production was produced in an automated 96-well format. SupT1 cell transduction was also performed via an automated 96-well format. CAR expression was manually analyzed by FACs and the results are shown in FIGS. 28A and 28B. All tested BCMA CARs showed comparable levels and consistency of viral titer.

Thus, taking together the results from the in vitro and in vivo experiments as outlined in Table 25, BMCA-4, BCMA-10, BCMA-13, and BCMA-15 were identified as having met the criteria for each assay and are good prospects for further testing for therapeutic use. When more stringent criteria was used in the tumor regression analysis, in which only CAR constructs that reproducibly demonstrated anti-tumor efficacy in both experiments were analyzed further, then BCMA-10 and BCMA-13 were identified for further therapeutic testing.

Example 9: Characterization of Lead BCMA CAR Constructs

Figure 29:
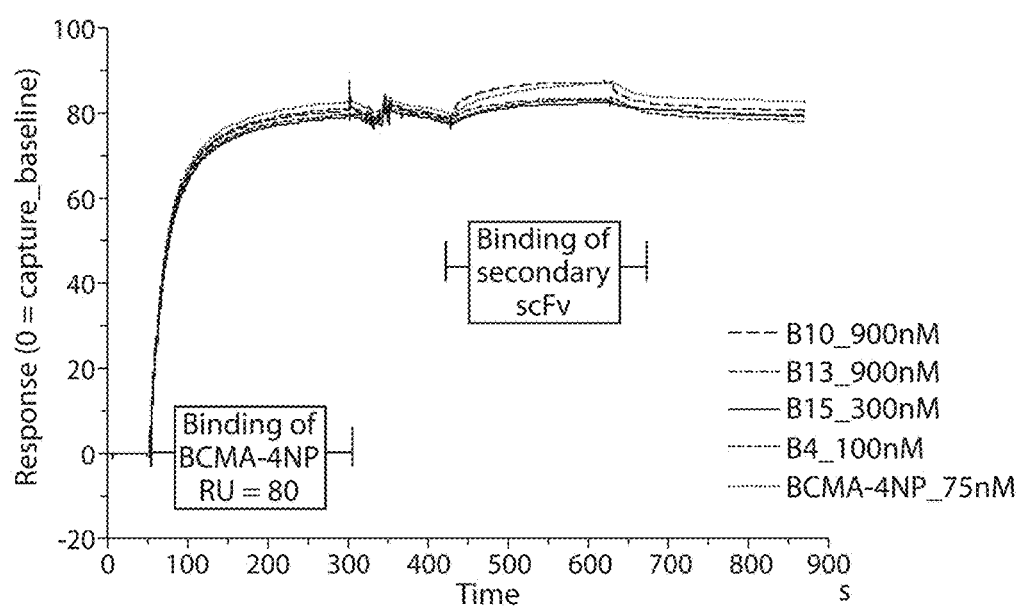
FIG. 29 is a graph showing the competition assay between BCMA-4NP and select BCMA CAR constructs, BCMA-4 (B4), BCMA-10 (B10), BCMA-13 (B13) and BCMA-15 (B15).
Figure 30A:
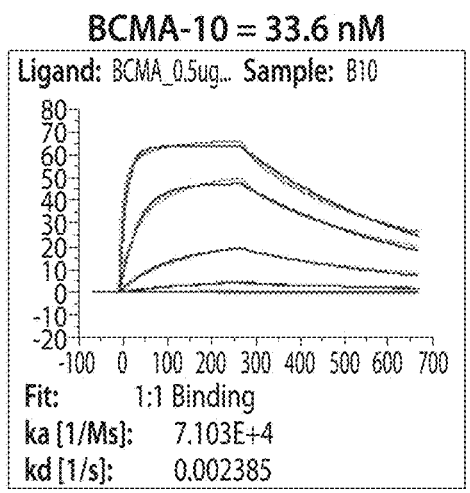
FIGS. 30A, 30B, 30C, 30D, and 30E are graphs showing the results of affinity assays for select BCMA constructs: BMCA-10 (FIG. 30A); BCMA-13 (FIG. 30B), BCMA-15 (FIG. 30C), BCMA-4 (FIG. 30D), and BCMA-4NP (FIG. 30E).
Figure 30B:
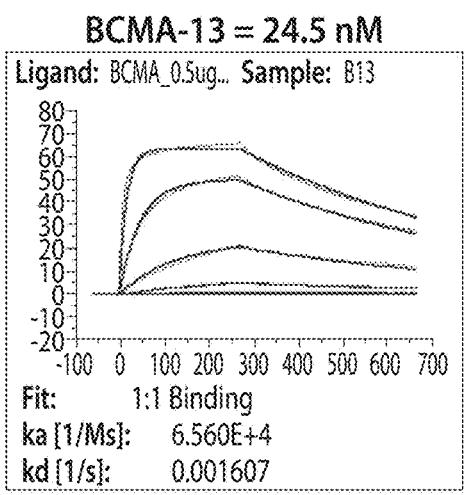
Figure 30C:
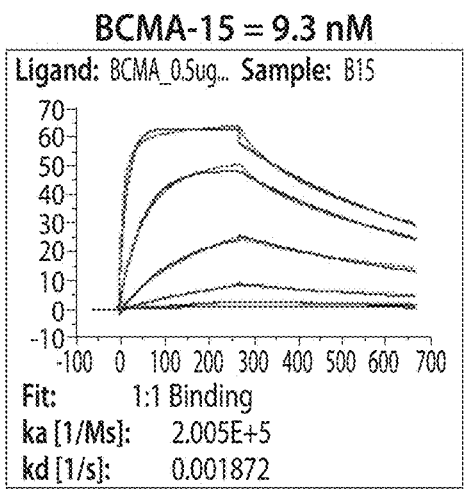
Figure 30D:
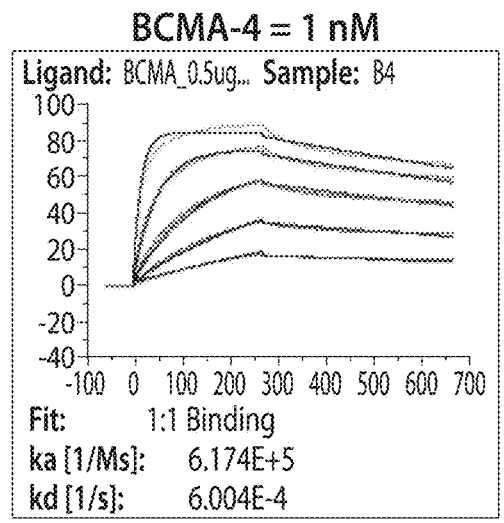
Figure 30E:
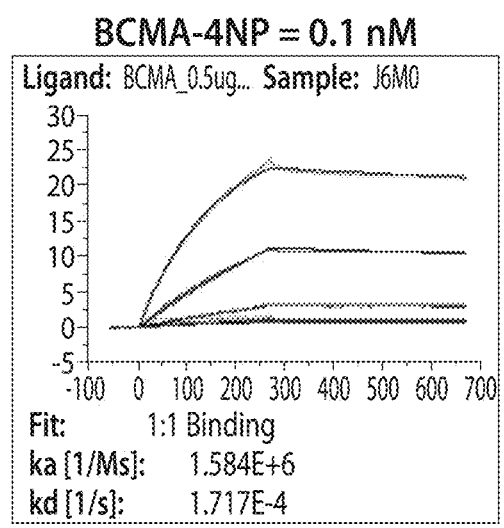

Additional assays were performed to characterize properties of the lead BCMA CAR constructs BMCA-4, BCMA-10, BCMA-13, and BCMA-15 CARs that have demonstrated in vitro and in vivo efficacy in various assays described in Examples 5-8. Sequence alignment of BCMA-10 and BCMA-13 showed that the two CARs have identical heavy chain CDRs and high homology in the light chain CDRs. A competition assay was performed between four lead candidates BMCA-4, BCMA-10, BCMA-13, and BCMA-15 CARs and BCMA-4NP (tool CAR) as the control. BCMA-4NP was incubated with BCMA substrate, and binds between 50 and 300 seconds after incubation, as shown in FIG. 29. The four BCMA CAR constructs are added and binding to the substrate was monitored. As shown in FIG. 29, all four BCMA CAR constructs were competitive with the BCMA-4NP control, indicating that all four candidate BCMA CARs bind to the same epitope as the BCMA-4NP tool CAR. At the given concentrations, if the candidate CARs were binding to a different epitope, the expected RU change would be about 70 RU. The small RU change observed during binding of the candidate BCMA CARs was due to the slight dissociation of the BCMA-4NP control sample from BCMA.

Antibody affinity was also assessed for the candidate BCMA CARs: BCMA-4, BCMA-10, BCMA-13, and BMCA-15. The results are shown in FIGS. 30A-30E, and summarized in the table below.

TABLE 26

BCMA CAR binding affinity

| Sample | Fit | ka | kd | KD |
|---|---|---|---|---|
| BCMA-10 | 1:1 Binding | 7.10E+04 | 2.39E−03 | 33.6 |
| BCMA-13 | 1:1 Binding | 6.56E+04 | 1.61E−03 | 24.5 |
| BCMA-15 | 1:1 Binding | 2.01E+05 | 1.87E−03 | 9.3 |
| BCMA-4 | 1:1 Binding | 6.17E+05 | 6.00E−04 | 1.0 |
| BCMA-4NP | 1:1 Binding | 1.58E+06 | 1.72E−04 | 0.1 |

BCMA-10 and BCMA-13 have similar affinities and are the lowest affinities of the tested candidates.

Figure 31:
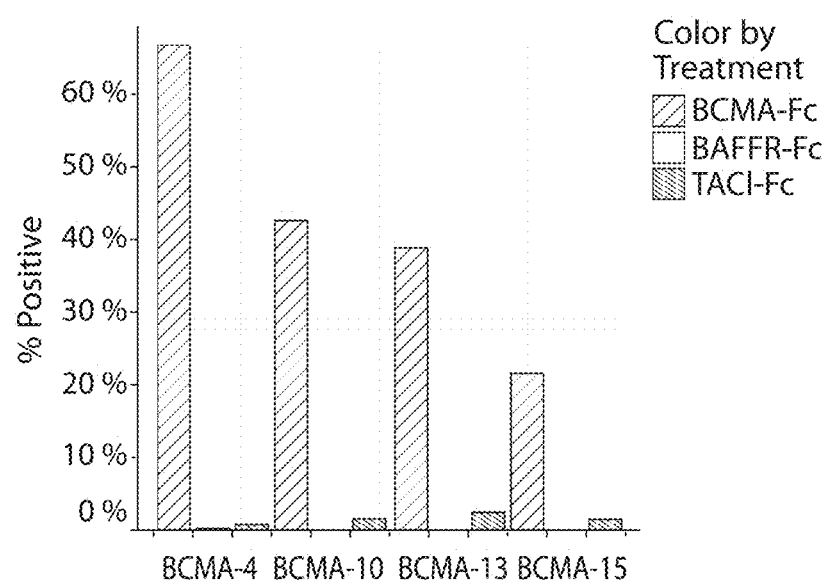
FIG. 31 is a graph showing the selective binding of select BCMA CAR-expressing T cells for recombinant BCMA. Recombinant forms of BCMA and closely related family members BAFFR and TACI comprising the proteins fused to Fc domains were incubated with T cells expressing BCMA-4, BCMA-10, BCMA-13, and BCMA-15. The percentage of cells that bound to the recombinant proteins (% positive cells) was detected.

Selective binding of the candidate BCMA CARs was also tested. BCMA is one receptor in the TNF receptor family, includes closely related family members BaffR and TACI. BCMA has about 41% homology to BaffR and about 22% homology to TACI. T cells expressing the candidate BCMA CARs BCMA-4, BCMA-10, BCMA-13, and BCMA-15 were incubated with recombinant BCMA, BaffR, or TACI fused to Fc regions. Binding was assessed by staining CAR+ cells (FIG. 31). The results indicate that specific binding was only observed between all of the BCMA-expressing T cells and recombinant BCMA-Fc, demonstrating that the BCMA CAR constructs selectively bind to BCMA.

Example 10: BCMA Expression in the Brain

Figure 32A:
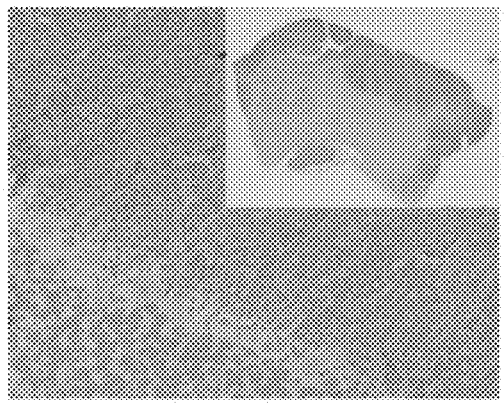
FIGS. 32A, 32B, 32C, 32D, 32E, and 32F are a series of images depicting the immunohistochemical staining of BCMA in brain tissue. BCMA-staining in climbing fibers of the cerebellum of cynomolgus macaque (FIG. 32A). BCMA-staining in the neuronal cell bodies in the inferior olivary nucleus of cynomolgus macaque (FIG. 32B). BCMA-staining (FIG. 32C) and Ig staining (control) (FIG. 32E) in cynomolgus macaque medulla oblongata. BCMA-staining (FIG. 32D) and Ig staining (control) (FIG. 32F) in human medulla oblongata.
Figure 32B:
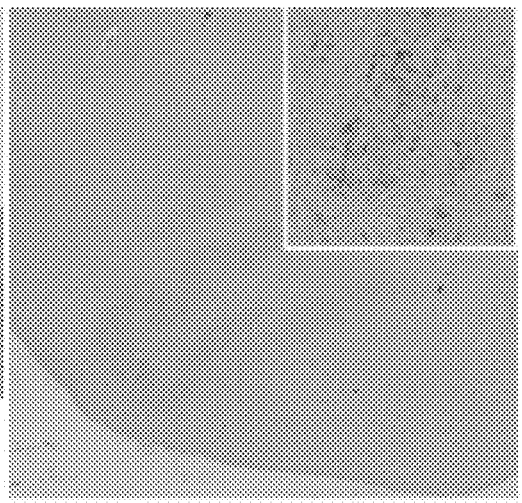
Figure 32C:
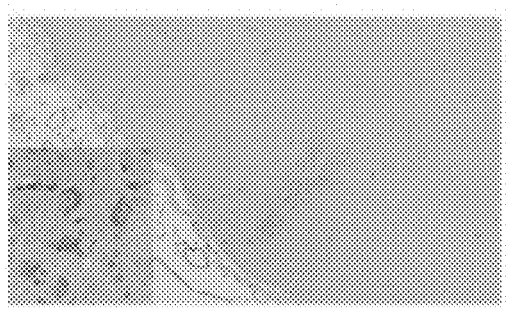
Figure 32D:
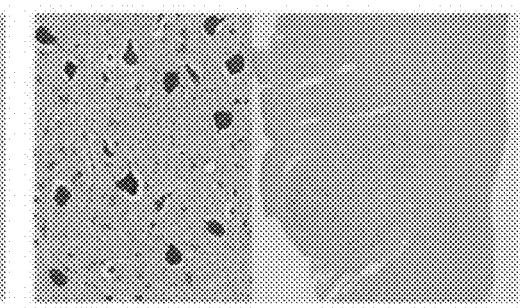
Figure 32E:
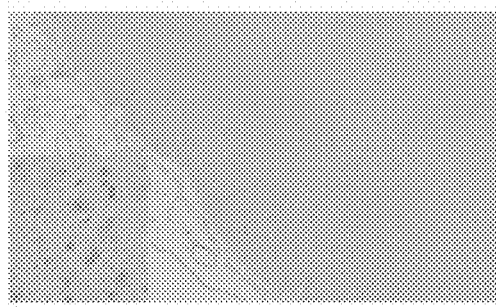
Figure 32F:
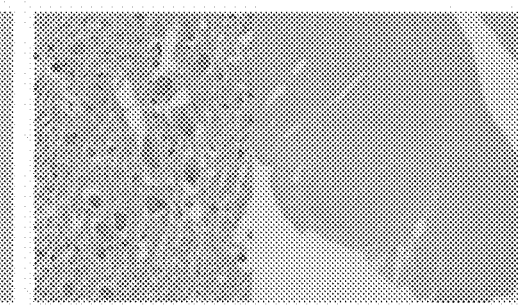

The tissue microarray results shown in Table 15 indicated that by immunohistochemical analysis, BCMA expression was detected in the cerebellum. Human and non-human primate formalin fixed paraffin embedded (FFPE) brain tissues were stained with anti-BCMA antibodies, e.g., USBio rabbit polyclonal antibody (0807-50G) raised to a BCMA intracellular epitope, and J6MO rabbit chimera antibody recognizing a BCMA extracellular epitope. Staining with the UsBio rabbit polyclonal antibody in non-primate human (cynomolgus macaque) brain tissue resulted in positive staining of the cerebellar climbing fibers (FIG. 32A) and the cell bodies in the inferior olivary nucleus (FIG. 32B) of the cerebellum. Staining of non-human primate brain tissue with J6MO resulted in BCMA positive staining only in the inferior olivary nucleus (FIG. 32C; Ig control staining in FIG. 32E). Similarly, staining of human brain tissue with J6MO also resulted in BCMA positive staining only in the inferior olivary nucleus (FIG. 32D; Ig control staining in FIG. 32F).

Figure 33A:
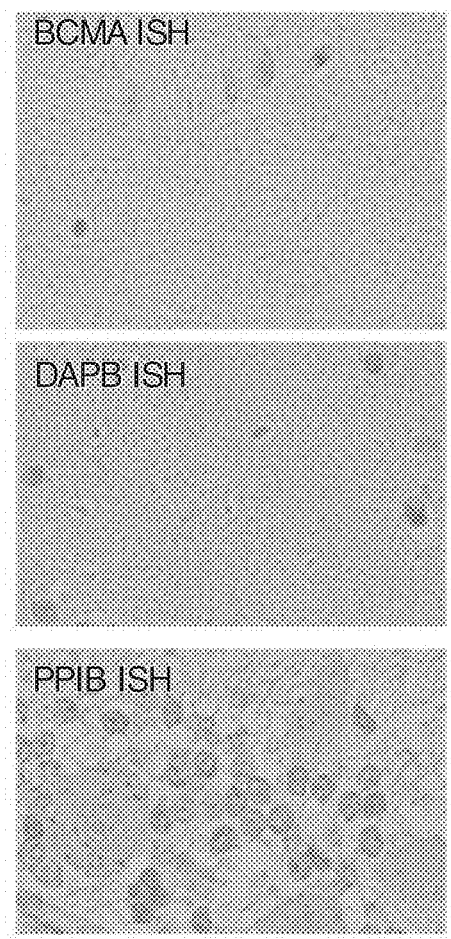
FIGS. 33A, 33B, 33C, 33D, and 33E are a series of images and a graph that depicts RNA analysis of BCMA expression in brain tissue. BCMA, DAPB, and PPIB RNA in situ hybridization of non-human primate cerebellum (FIG. 33A). BCMA, DAPB, and PPIB RNA in situ hybridization of non-human primate medulla oblongata (FIG. 33B). Quantitative PCR analysis of BCMA in cerebellum, medulla oblongata, stomach, and kidney in human (FIG. 33C). Quantitative PCR analysis of BCMA in white matter, grey matter, medulla oblongata, stomach, and kidney in cynomolgus macaque (FIG. 33D). RNAseq analysis of normal tissue in human (FIG. 33E); the box indicates BCMA-expression in cerebellum.
Figure 33B:
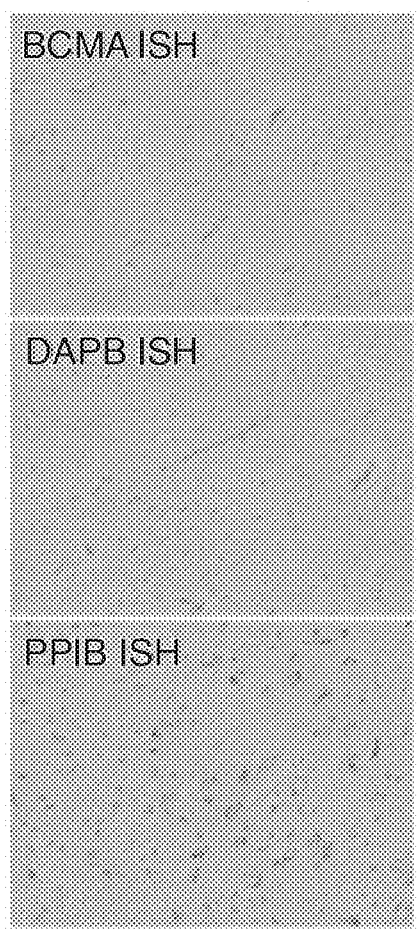
Figure 33C:
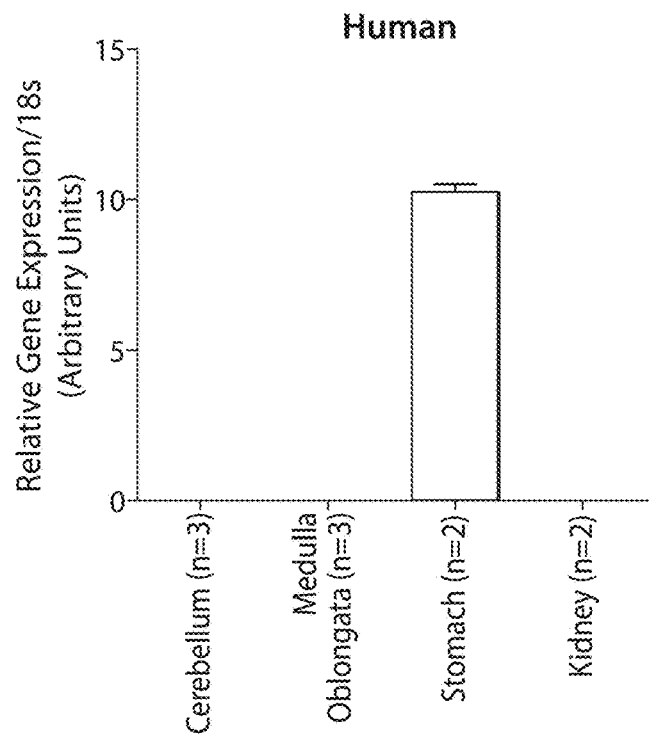
Figure 33D:
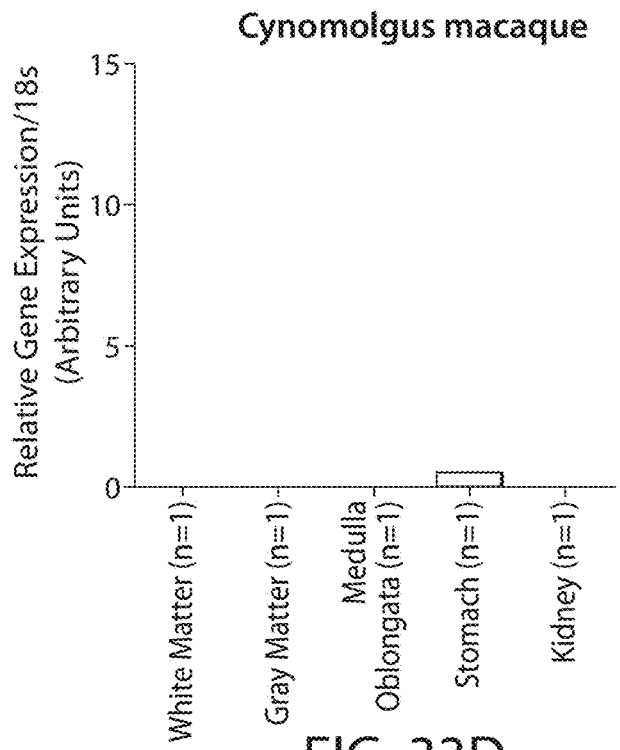

The immunohistochemistry results were confirmed by RNA analysis. In situ hybridization of non-human primate and human brain tissue was performed. Both the cerebellum and medulla oblongata was BCMA negative by mRNA detection by in situ hybridization (FIGS. 33A and 33B). Quantitative PCR was also performed on cerebellum, medulla oblongata, stomach, and kidney tissues from non-human primate (cynomolgus macaque) and human. The qPCR results indicate that BCMA mRNA was not detected in the cerebellum and the medulla oblongata of human (FIG. 33C) or non-human primate (FIG. 33D). The potential discrepancy between the immunohistochemical and RNA analysis may be due to the different BCMA splice variants known in the art (Smirnova et al., *Mol Immunol*, 2008, 45:1179-83).

Figure 33E:
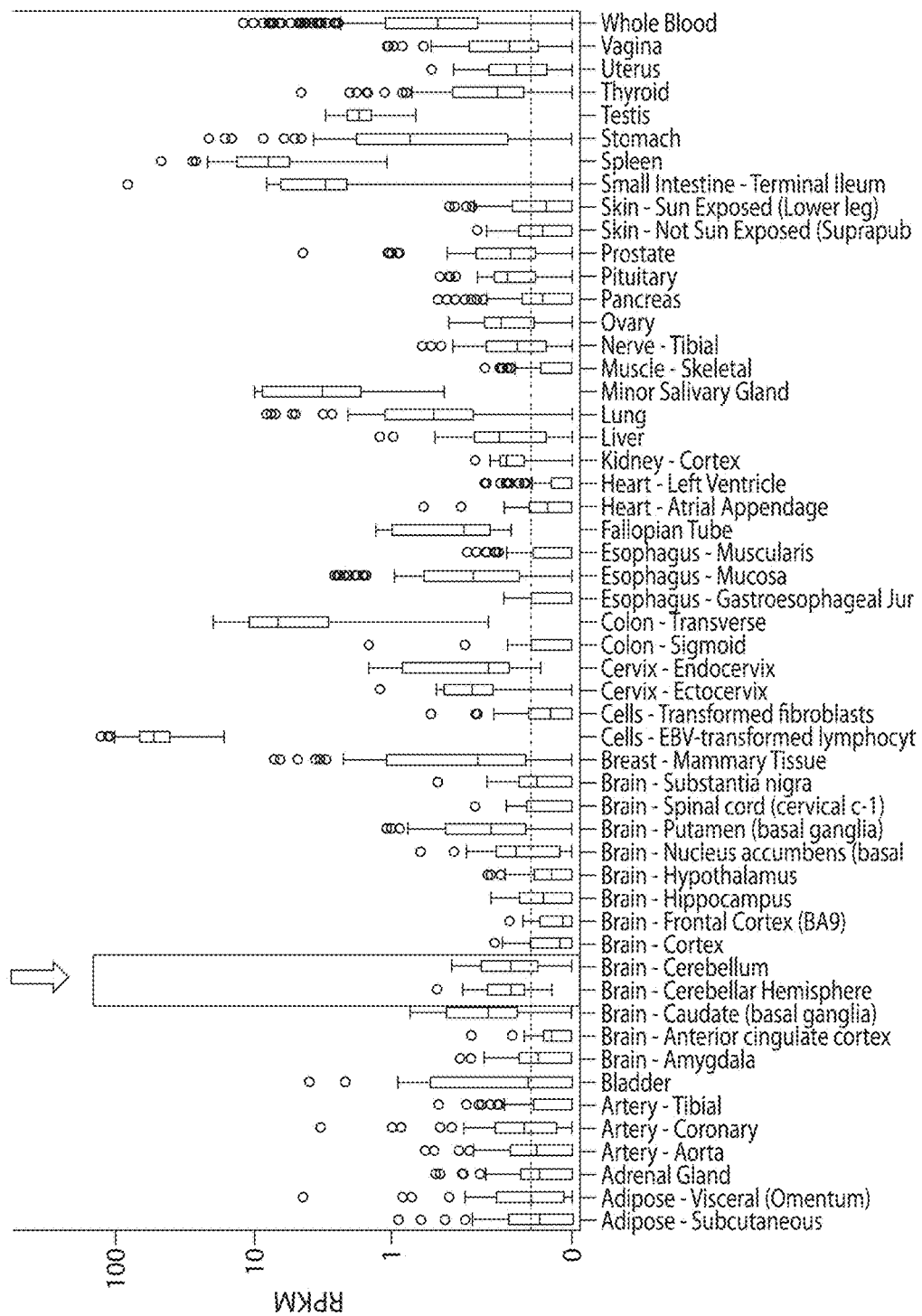

RNAseq analysis, which would detect all BCMA isoforms and splice variants, was performed on normal tissues. The results show that little or no expression of BCMA was detected by RNAseq in normal tissue (FIG. 33E).

Further analysis is performed to determine whether the BCMA detected protein would be accessible to BCMA CART cells, and the implications for BCMA CART therapy. PCR probes are redesigned and BCMA splice variant expression is re-assessed. Single cell RNAseq in cerebellum samples is performed. Confocal microscopy analysis is performed to visualize intracellular staining. Mice are also evaluated for effects on the brain in efficacious CARTs, e.g., BCMA-10 and BCMA-13. To prevent potential trafficking of BCMA CART cells to the brain, natalizumab can be administered to subjects.

Example 11: BCMA CART Therapy in Relapsed/Refractory Myeloma

This example provides a single cohort, open-label pilot study to assess the safety and feasibility of infusion of autologous T cells expressing BCMA-specific CARs in relapsed and/or refractory multiple myeloma. The BCMA-CARs comprise tandem TCRζ and 4-1BB (TCRζ/4-1BB) costimulatory domains, and the T cells expressing the BCMA-CARs are referred to as BCMA CAR T cells.

Study Objectives

The primary objective of the study is to determine the safety and tolerability of BCMA CAR T cells in MM patients. The secondary objectives include: describe outcomes, including response rates, minimal residual disease (MRD) rates, progression-free and overall survival; and assess the feasibility of manufacturing BCMA CAR T cells. The exploratory objectives include: characterize BCMA CAR T cells with respect to their expansion, persistence, homing, phenotype and function; evaluate for development of cellular and/or humoral immunity against BCMA CAR T cells; evaluate effect of BCMA CAR T cells on B cell and plasma cell compartments, including immunoglobulin levels; determine the impact of BCMA CAR T cells on systemic soluble immune factors in patients; assess BCMA expression on MM cells pre- and post-treatment; and evaluate safety and efficacy of re-treatment with BCMA CAR T cells in patients who progress after prior clinical benefit Study Duration The duration of active intervention and monitoring is approximately 2 years. After 2 years, monitoring for delayed adverse events will transition to a separate long term follow-up protocol in accordance with FDA guidelines. The protocol will require approximately 12-18 months to complete enrollment.

Diagnosis and Main Inclusion Criteria

Up to 12 evaluable subjects will be enrolled.

Inclusion criteria include adult patients aged >18 with relapsed and/or refractory multiple myeloma after at least 3 prior lines of therapy that must include a prior alkylator, a proteasome inhibitor (PI) and immunomodulatory drug (IMiD) (or 2 priors if double-refractory to an IMiD (immunomodulatory drug, thalidomide and lenalidomide), and proteasome inhibitor). The patients have relapsed, defined as meeting IMWG (International Myeloma Working Group) criteria for PD) or are refractory, as defined as achieving <PR) after the most recent regimen. The patients have a limited prognosis (≤2 year expected survival) with currently available therapies.

Study Product, Dose, Route, Regimen

Single infusion of BCMA CAR T cells administered by intravenous infusion. Cohort 1 will receive 1-5×10$^8$ BCMA CAR T cells alone, calculated as a range of 2-50% transduced cells in total cells (The cell dose in Cohort 1 may be decreased to 1-5×10$^7$ BCMA CAR T cells (Cohort-1) if there is unexpected severe toxicity). Cohort 2 will receive cyclophosphamide (cytoxan) 1.5 g/m$^2$, administered by i.v. infusion, 1-3 days prior to infusion of 1-5×10$^7$ BCMA CAR T cells. Cohort 3 will receive cyclophosphamide 1.5 g/m$^2$, administered by i.v. infusion, 1-3 days prior to infusion of 1-5×10$^8$ BCMA CAR T cells.

Figure 34:
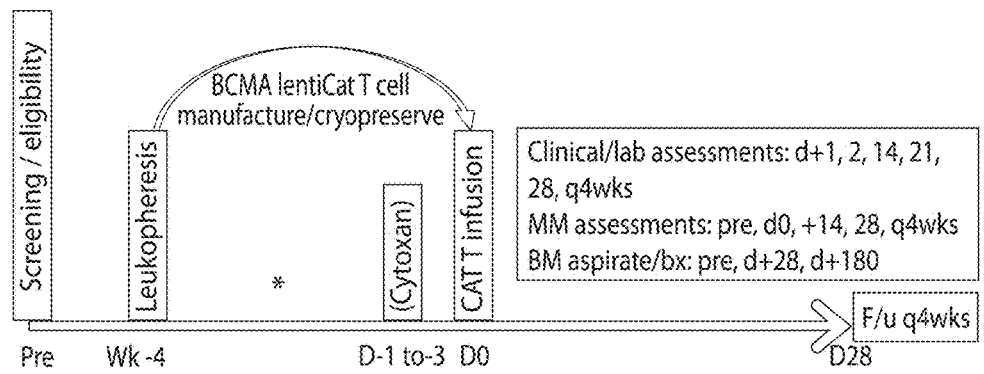
FIG. 34 is a schematic diagram showing the timeline of the study to assess the safety and feasibility of BCMA CART cell therapy in relapsed and/or refractory myeloma.

Based on the total volume to be infused and the recommended infusion rate of 10-20 mL per minute. The dosage and regimens for each cohort is summarized in the table below and a schematic diagram is shown in FIG. 34.

TABLE 27

Summary of cohorts and dosages

| Cohort | Lymphodepleting chemo | BCMA-CAR T cell dose |
|---|---|---|
| −1 | — | 1 to 5 × 10$^7$ |
| 1 (n = 3) | — | 1 to 5 × 10$^8$ |
| 2 (n = 3) | Cytoxan 1.5 g/m$^2$ | 1 to 5 × 10$^7$ |
| 3 (n = 6) | Cytoxan 1.5 g/m$^2$ | 1 to 5 × 10$^8$ |

To prevent potential trafficking of T-cells to the brain, patients can be administered natalizumab (TYSABRI®).

Patient Monitoring

Tumor response will be measured by serum and urine protein electrophoresis and immunofixation; bone marrow biopsy; and imaging if skeletal lesions are present prior to treatment. Neural exams will also be performed before and after therapy to ensure no neural changes.

Statistical Methodology

The statistical analysis will be primarily descriptive in keeping with the exploratory nature of the study. Descriptive statistics will be applied to determine the relative engraftment, persistence and trafficking of the study drug components to blood and bone marrow. All adverse events will be described and exact 95% confidence intervals will be produced for adverse event rates, both overall and within major categories. Analysis of other secondary endpoints such as anti-tumor activity will also be primarily descriptive and may include summary statistics such as means and standard deviations or Kaplan-Meier curves for survival information.

Example 12: Cytokine Secretion from CART Cells

Figure 35A:
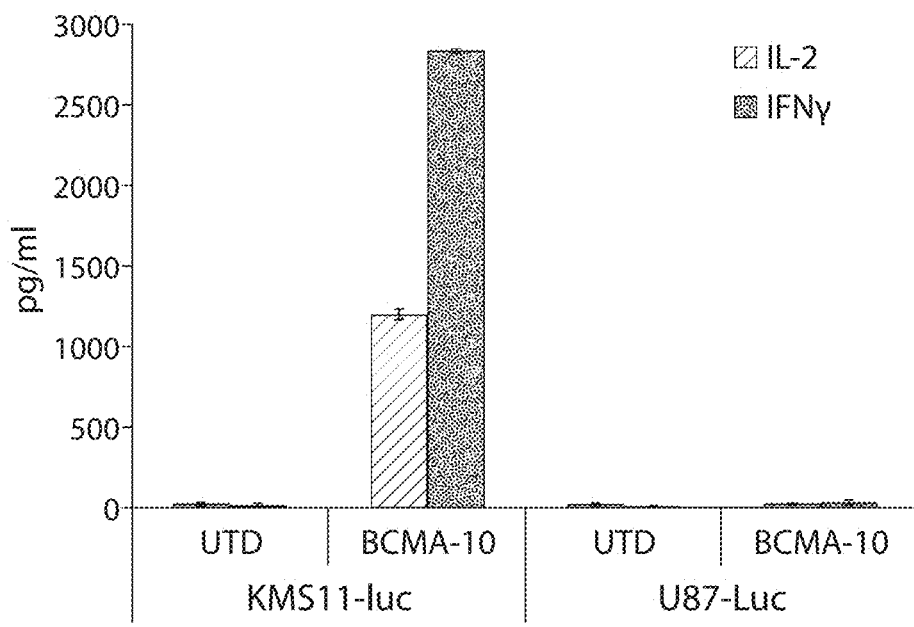
FIGS. 35A and 35B are graphs showing the concentration of cytokines secreted by BCMA-10 CARTs when co-cultured with target cells.
Figure 35B:
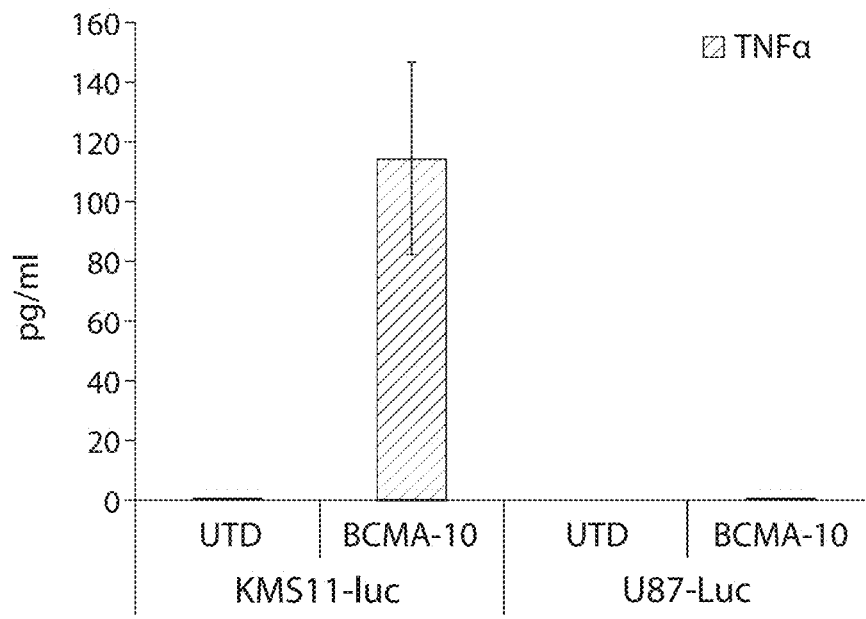

The ability of CART cells to secrete cytokines in response to target was determined. CART cells containing BCMA-10 CAR or untransduced T-cells were co-cultured with BCMA-positive (KMS11-luc) or BCMA negative (U87-luc) target cells, and the secretion of IL-2, IFNγ, and TNFα into the media was measured. Specifically, thawed CAR T cells containing either BCMA-10 CAR or untransduced were co-cultured with target cells for 20 h at an effector:target ratio of 2.5:1. Target cells included BCMA positive luciferized KMS-11 (KMS11-luc) or BCMA negative luciferized U87 cells (U87-luc). Effector cells were cultured in 96-well U-bottom plates with $3 \times 10^4$ target cells in a total volume of 200 µL/well in complete T cell media. After 20 h, supernatants were removed from the cultures, and IFNγ, IL-2, and TNFα secretion were quantified by cytometric bead array (BD Bioscience) on FACS according to manufacturer's instructions. Measurements were in duplicate. Error bars represent the standard deviation (FIGS. 35A-35B). The results show that the BCMA-10 CARTs but not untransduced T-cells were stimulated to produce cytokines by BCMA-expressing but not BCMA-negative target cells (FIGS. 35A-35B).

Example 13: Function of BCMA-CART in Multiple Myeloma

Multiple Myeloma (MM) is a malignancy of plasma cells in the bone marrow with clinical features that include anemia, skin lesions, bone tenderness or pain, tiredness, osteolytic lesions, hypercalcemia, kidney failure and recurrent bacterial infection as most common. Despite the fact that recent treatments with drugs such as lenalidomide produce a significant increase in survival of relapsed MM, the disease is almost always incurable. The median 5-year survival rate is about 35%. Due to poor prognosis, an effective targeted therapy is needed.

Treatments using T-cells engineered to express chimeric antigen receptors (CAR) can result in promising immunotherapies for hematologic malignancies such as ALL. CARs contain a fusion protein that recognizes a cell-surface target protein expressed on a tumor cell. Differential gene expression studies have identified B-cell maturation antigen (BCMA, CD269) as a highly specific target antigen for malignant plasma cells and normal plasma cells; thus, BCMA is a potentially useful target antigen for CAR T cell therapy. See, e.g., Carpenter et al. Clin Cancer Res. 19.8 (2013):2048-60.

BCMA is a member of the TNF-receptor superfamily. The protein is encoded by TNFRSF17 gene. BCMA is expressed in mature B lymphocytes. It binds to the tumor necrosis factor (ligand) superfamily, member 13b (TNFSF13B/TALL-1/BAFF), APRIL and to various TRAF family members. Interaction with their ligands leads to NF-kappaB and MAPK8/JNK signals that are linked to B cell development, long term plasma survival, and cell proliferation.

This example describes a preclinical study to evaluate the in vitro and in vivo function of huBCMA-BBz CAR-transduced T cells (CART-BCMA or BCMA-CART) that incorporates the BCMA10 scFv.

Materials

T Cells.

T cells from healthy donors were obtained from the University of Pennsylvania CFAR Human Immunology Core (Philadelphia, Pa.). Cells were prepared from the leukapheresis of healthy volunteer donors.

Medium.

RPMI medium (Gibco) supplemented with 10% Fetal Bovine serum and filtered (Valley Biomedical), 2 mM GlutaMax, (Invitrogen), 10 mM HEPES (Invitrogen), 100 U/ml Pencillin and 100 ug/ml Streptomycin (Gibco) was used.

CD3/28 Beads.

CD3/28 beads (GMP-grade) were manufactured by Clinical Cell and Vaccine Production Facility at University of Pennsylvania.

Plasmids.

The huBCMA-BBz CAR construct cloned in the pELPS lentiviral vector NVP-MCM998 was generated by Novartis.

Antibodies.

The antibodies, goat anti-human BCMA PE labeled (Biolegend cat#357504), and streptavidin (BD Biosciences), were used to detect BCMA expression on multiple myeloma cell lines. For CAR T cell expression, BCMA fc fusion protein (R&D Systems, cat#193-BC-050) was used followed by anti-human IgG fc-PE antibody (Biolengend, cat#409304).

PBS.

PBS was from Gibco.

Lentiviral Package.

PCL USUG, PRSV Rev, PGAG pol plasmids (Nature Technology corp. cat# NTC RP20) were used for huBCMA-BBz lentiviral preparation by transfecting with Lipofectamine 2000 (Invitrogen Cat#11668027) on 293T cells.

Cell Lines.

Human embryonic kidney 293T cells (ATCC cat# CRL-3216) were used for lentiviral preparation. Multiple Myeloma cell lines RPMI 8226 (ATCC cat# CCL-155), MM1S (ATCC cat# CRL-2974), U266 (ATCC cat# CRL-3216), NCI H929 (ATCC cat# CRL-9068) and OPM2 (DSMZ cat# ACC-50); and K562 (ATCC cat# CCL-256), or K562-BCMA cells (BCMA Lentiviral vector from Genecopoeia cat# Lv105) were used for functional experiments on CART-BCMA cells.

Methods

Lentiviral Production Protocol and Titer Determination.

293T cells were seeded at $8.10^6$ cells/per flask in a T150 flask (Corning Costar Cat. #430825) with RPMI1640 medium (Gibco Cat. #11875-080) supplemented with 10% FBS (ATCC cat #30-2020) and strep/penicillin (Invitrogen cat #10378-016) and transfected with packing plasmids mix (Nature Technology corp.) plus huBCMA-BBz encoding pELPS lentiviral vector for 24 hrs. The resulting viral preparation was stored at −80° C. Recombinant lentivirus was titered on CD4 T.

Transduction Protocol.

T cells obtained from the Human Immunology Core were washed once in media, re-suspended at $10^6$ cells/ml, and stimulated with CD3/28 beads at a cell:bead ratio of 1:3.

Lentivirus transduction was performed on day 2 by mixing the lentivirus vector into the cell cultures at an MOI of 3.

T Cell Expansion.

Stimulated T cells were fed and split every 2-3 days to $0.8 \times 10^6$ cells/ml for 7-9 days or until cells were rested as determined by decreased rate of cell division and a decrease in mean cellular volume to <~300 fl.

Cell Cultures.

Multiple Myeloma cell lines and K562, K562 BCMA cell lines were cultured in RPMI with 10% FBS and antibiotics.

Cell Counting.

Cells were counted every 3 days during the expansion by gently mixing cultures and collecting 40 ul of cells from culture volume and placed into accuvettes (Beckman Coulter) with 20 ml Isoton II Diluent Buffer for counting using a Coulter Multisizer 3 (Beckman Coulter). The results of this test (absolute cell count and cell volume) were used to determine cell concentration, total cell numbers, growth rates, and dilution volumes.

$^{51}$Cr Release-Assay.

The ability of CART-BCMA cells to kill BCMA-expressing target cells was evaluated using a $^{51}$Cr release-assay. Briefly, target K562-BCMA cells (or control K562 cells) and multiple myeloma cell lines were labeled with $^{51}$Cr (Sodium Dichromate salt), washed and co-cultured with effector CART-BCMA or control non-transduced T cells (NTD) at different effector/target ratios. Supernatants were collected a 4-hrs, and placed into 96 well Lumaplates (Perkin Elmer). The amount of $^{51}$Cr released from the labeled target cells was measured on a liquid scintillation counter (MicroBeta trilux, Perkin Elmer). Target cells incubated in medium alone or with 1% SDS were used to determine spontaneous (S) or maximum (M) $^{51}$Cr release. Percentage of specific lysis was calculated as follow: 100×(cpm experimental release–cpm S release)/(cpm M release–cpm S release).

CAR Detection on Transduced T Cells.

To evaluate transduction of CART-BCMA, T cells were stained with BCMA-Fc fusion protein (R&D Systems) followed by anti-human IgG Fc-PE antibody (Biolengend).

Flow Cytometry.

For anti-BCMA staining, human myeloma cell lines were stained with goat anti-human-PE BCMA antibody (Bioloegend) followed by streptavidin (BD Biosciences). Flow cytometry analysis for all experiments was carried out by using FlowJo (Tree Star, Inc.).

ELISA.

Target K562-BCMA cells (or control K562 cells) or multiple myeloma cell lines were combined with CAR-transduced T cells at a target:effector ratio 1:3 in duplicate wells of a 96 well flat bottom plate. ELISA assay was performed in a 1:10 dilution of supernatant collected after 16 hr of incubation by using the human IFNγ or IL2 Duoset ELISA kit (R&D) as recommended by the manufacturer.

Results huBCMA-BBz was Highly Expressed on Transduced T Cells.

Figure 36A:
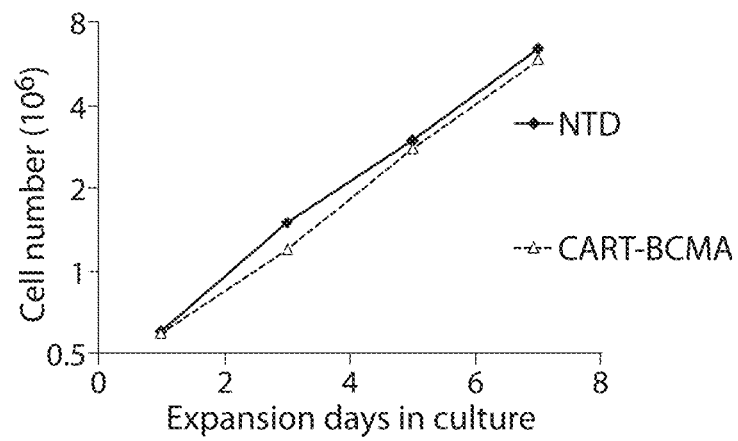
FIGS. 36A and 36B are graphs/plots showing the growth curve and efficiency of huBCMA-BBz lentiviral transduction of T cells.

Freshly purified negatively selected normal human T cells were activated in vitro using CD3/28 beads (cell:bead ratio 1:3) and allowed to expand. On day 1 post-activation, cells were transduced with the preclinical lentiviral vector expressing huBMCA-BBz or mock transduced (NTD control). FIG. 36A shows the increase of total T cells during culture. BCMA-CART cells were counted every 3 days and adjusted for the ratio of split cells. T cells were enumerated using a Coulter Counter Multisizer III and fed every 2 days until the end of the expansion cycle (Day 7-9). On day 6 of ex vivo expansion, 200 ul of CART-BCMA or control NTD T cells were stained as described in the Methods section above. The live cell populations were gated using FCS vs. SSC. The flow acquisition was performed on a BC FACS Canto instrument and the flow analysis was performed using FlowJo software (TreeStar, Inc).

Figure 36B:
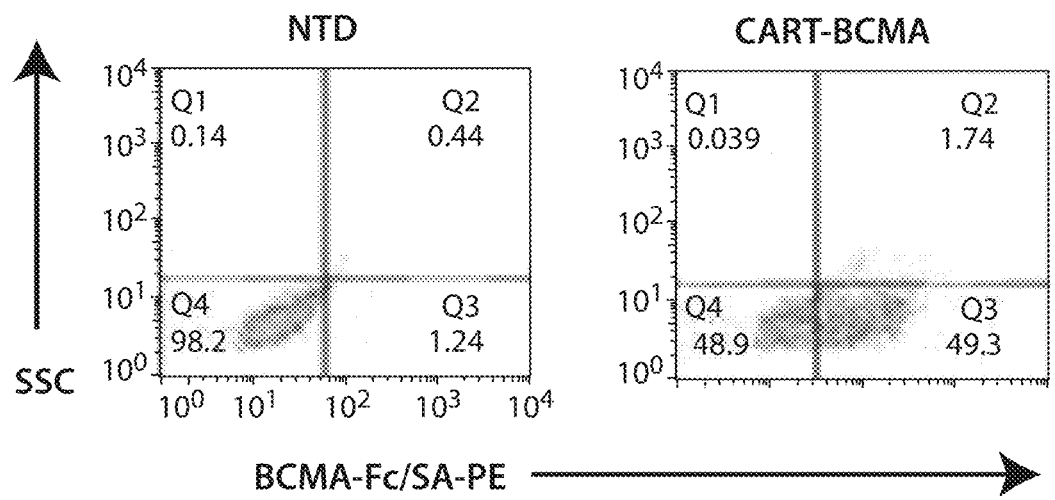

No differences in the proliferation rates of non transduced (NTD) and CART-BCMA cells were observed, indicating that lentiviral expression did not affect the proliferative potential of T cells (FIG. 36A). Transduction efficiency was evaluated at day 6 post-transduction as described in the methods section above. FIG. 36B shows that huBCMA-BBz transduction efficiency was 49%. These results demonstrate that huBCMA-BBz CAR was efficiently expressed on the surface of human T cells.

BCMA was Expressed at Different Levels on Multiple Myeloma Cell Lines.

Figure 37:
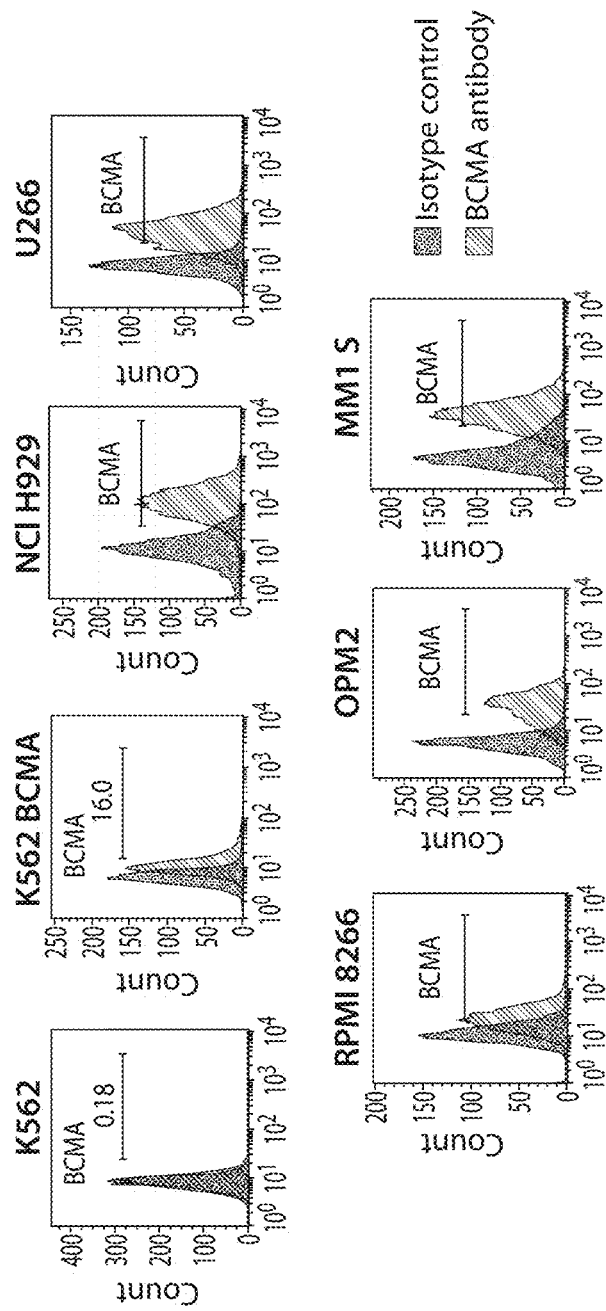
FIG. 37 is a panel of flow cytometry histograms showing the BCMA surface expression on various cell lines, including K562-BCMA cells and multiple myeloma cell lines NCI H929, U266, RPMI 8226, OPM2 and MM1S. For all plots, the orange solid peak represents isotype control and the blue solid peak staining with BCMA antibody.

BCMA surface expression on multiple myeloma cell lines was determined using flow cytometry staining. The live cell populations were gated by FCS/SCC parameters. The flow acquisition was done on a canto instrument and the flow analysis with FlowJo software. Most multiple myeloma cell lines tested showed strong BCMA expression, whereas RPMI 8226 and control K562-BCMA cells expressed lower levels of surface BCMA (FIG. 37). For all plots, the orange solid peak represents isotype control and the blue solid peak staining with BCMA antibody (FIG. 37). Flow cytometry staining revealed BCMA expression on the surface of the multiple myeloma cell lines NCI H929, U266, RPMI 8226, OPM2 and MM1S, as well as by K562-BCMA cells. BCMA was not detected on the surface of K562 cell line (FIG. 37). These results demonstrate that BCMA was expressed by several multiple myeloma cell lines with expression levels varying by about 1 log.

CART-BCMA Cells Produced Cytokines and Showed Cytotoxic Properties Specifically in Response to Different BCMA-Expressing, Multiple Myeloma Cell Lines.

The ability of CART-BCMA cells to produce cytokines and kill BCMA+ target cells was determined. CART-BCMA cells (huBCMA-BBz transduced T cells) or control non transduced T cells (NTD) were co-cultured in duplicates for 16 hrs with K562, K562-BCMA or multiple myeloma cell lines (MM1S, OPM2, or U266). Cells were co-cultured at a 3:1 ratio of T cell to target cells. Cell-free supernatant was harvested and the production of IL2 or IFNγ was evaluated as described in the Methods section above.

Figure 38A:
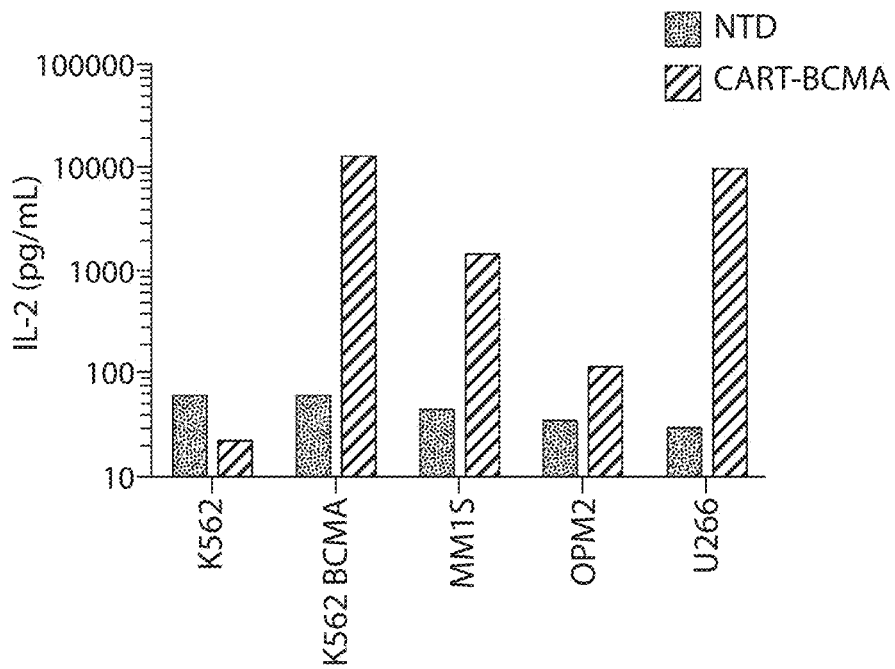
FIGS. 38A and 38B are graphs showing the concentration of cytokines produced by CART-BCMA cells in response to myeloma cell lines.
Figure 38B:
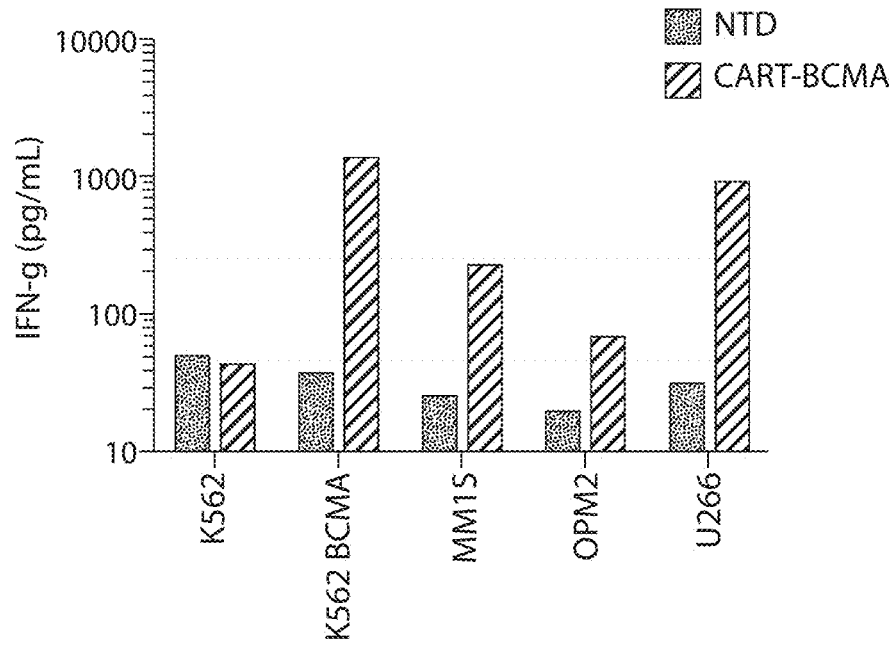

CART-BCMA cells specifically produced IL2 or IFNγ in the presence of K562 engineered to express BCMA (K562-BCMA) compared to non-antigen-expressing, wildtype K562 cells. CART-BCMA cells were also able to produce cytokines in the presence of U266, OPM2 and MM1S multiple myeloma cell lines (FIGS. 38A-38B). These results demonstrate that in the presence of BCMA+target cell lines, CART-BCMA cells produced pro-inflammatory cytokines.

Figure 39A:
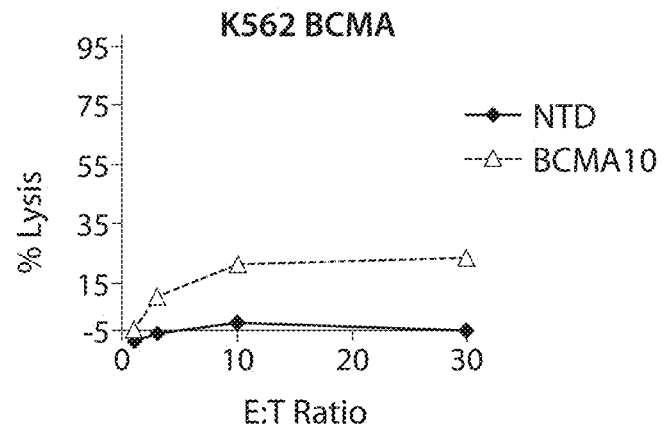
FIGS. 39A, 39B, and 39C are graphs showing the antigen-specific killing of BCMA multiple myeloma cell lines by CART-BCMA cells.
Figure 39B:
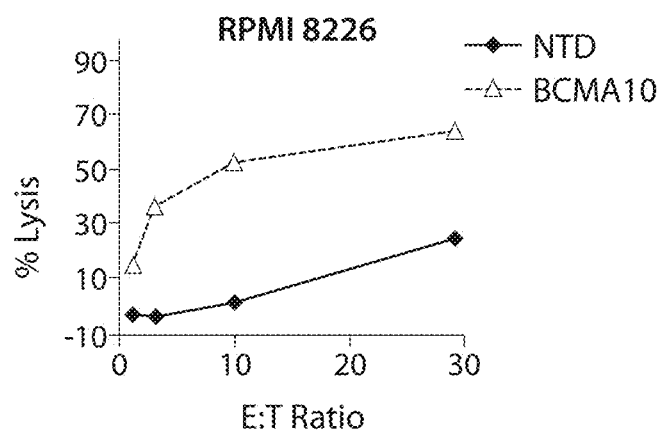
Figure 39C:
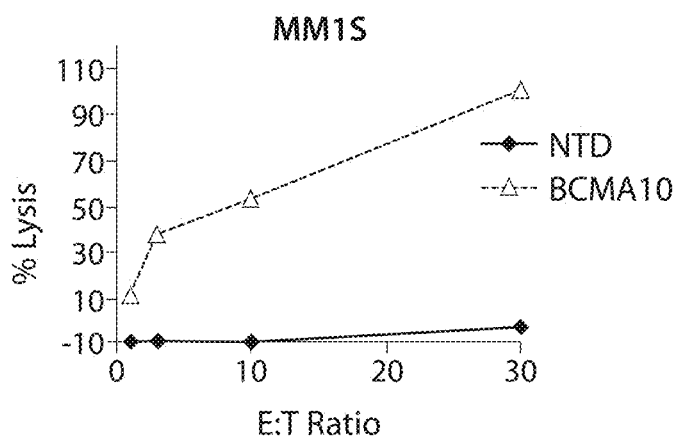

Another in vitro measure for the anti-tumor effectiveness of CART-BCMA cells is their ability to kill BCMA+target cells. T cells were activated and transduced, as described above, e.g., in relation to FIGS. 36A-36B. BCMA10 CAR T cells were co-cultured with $^{51}$Cr-labeled K562-BCMA, RPMI 8226 or MM1S cell lines for 4 hrs at the effector to target ratios (E:T Ratio) indicated in FIGS. 39A-39C (E:T of 0, 10, 20, or 30) and percentage of lysis was calculated as described in the Methods section above. FIG. 39A shows that CART-BCMA cells specifically killed K562-BCMA cells. CART-BCMA cells also efficiently killed the BCMA$^{high}$ multiple myeloma cell line MM1S and the BCMA$^{low}$ RPMI 8226 cell line in a 4-hr cytotoxicity assay (FIGS. 39B, 39C). These results demonstrate that CART-BCMA displayed enhanced cytotoxic activity ($^{51}$Cr assay) against multiple myeloma cell lines.

Antitumor Activity of CART-BCMA Cells In Vivo

Using RPMI 8226 cells, which show lower levels of BCMA expression compared to many other myeloma cells lines, a mouse model was established to evaluate the capacity of CART-BCMA to recognize and eliminate tumors produced by the BCMA$^{low}$ RPMI 8226 cell line engineered to express Click-beetle green luciferase (CBG) for bioluminescence imaging (BLI). NOD/SCID/γ-chain$^{-/-}$ (NSG) mice with established intravenous RPMI 8226 tumors received intravenous injections of CART-BCMA cells (N=10) or non transduced control T cells (NTD) (N=10) on day 30 following tumor cell inoculation. NSG mice engrafted with RPMI-8226 cells were treated with 5×10$^6$ CART-BCMA T cells at day 30 following tumor cell injection. Myeloma tumor progression was followed by in vivo BLI (BLI of ventral and dorsal mouse areas once per week) up to 9 weeks post-T cell infusion (14 weeks post-tumor injection).

Figure 40A:
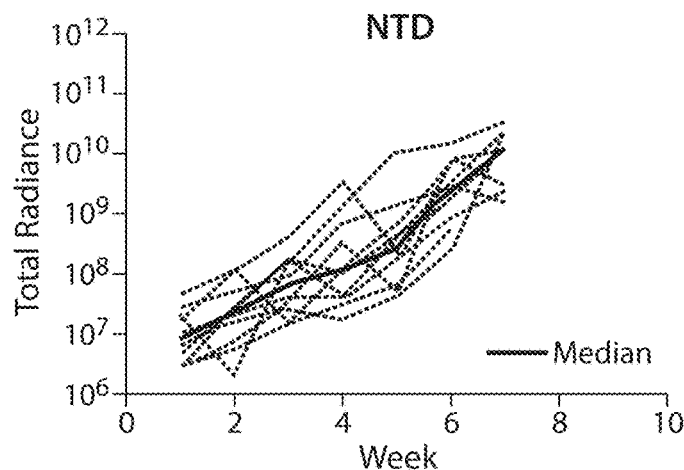
FIGS. 40A, 40B, and 40C are graphs showing that CART-BCMA cells displayed effective anti-myeloma activity in vivo.
Figure 40B:
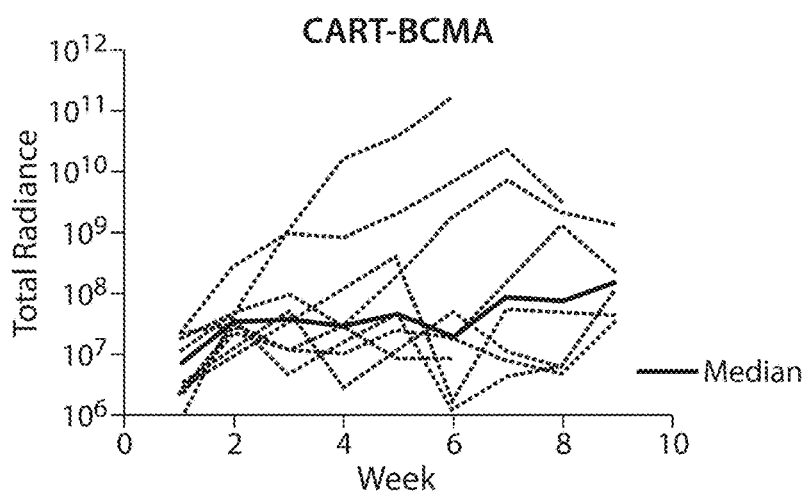
Figure 40C:
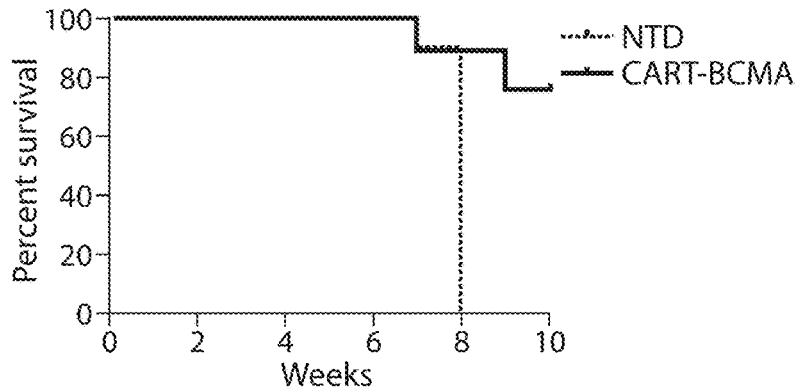
Figure 41A:
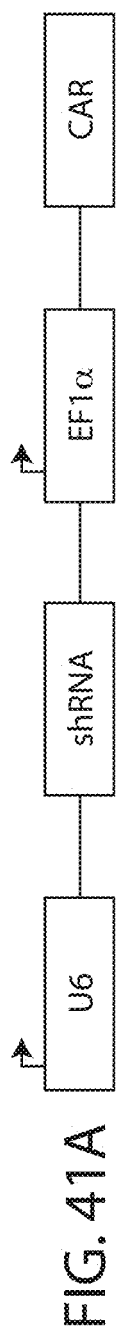
FIGS. 41A-41D show the various configurations on a single vector, e.g., where the U6 regulated shRNA is upstream or downstream of the EF1 alpha regulated CAR encoding elements. In the exemplary constructs depicted in FIGS. 41A and 41B, the transcription occurs through the U6 and EF1 alpha promoters in the same direction. In the exemplary constructs depicted in FIGS. 41C and 41D, the transcription occurs through the U6 and EF1 alpha promoters in different directions.
Figure 41B:
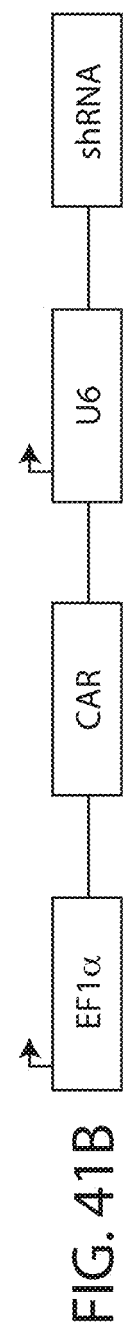
Figure 41C:
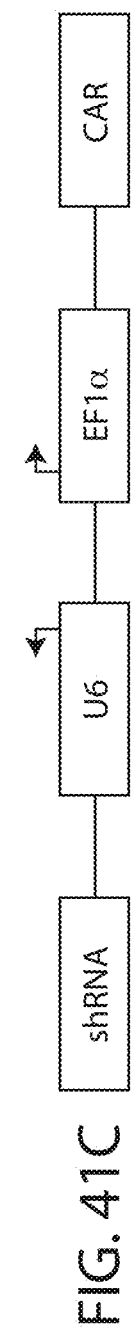
Figure 41D:
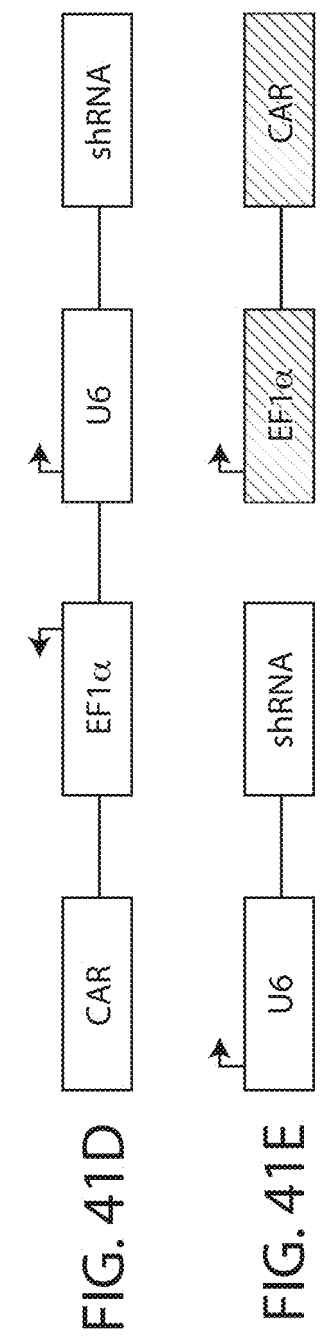
Figure 41E:
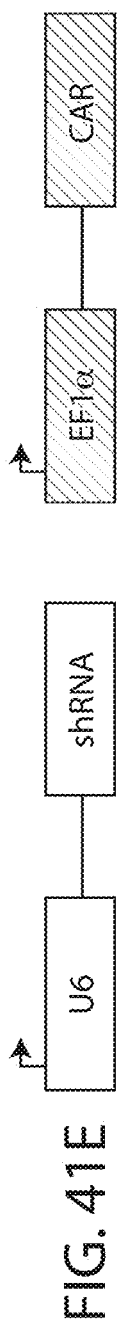
In FIG. 41E, the shRNA (and corresponding U6 promoter) is on a first vector, and the CAR (and corresponding EF1 alpha promoter) is on a second vector.
Figure 42:
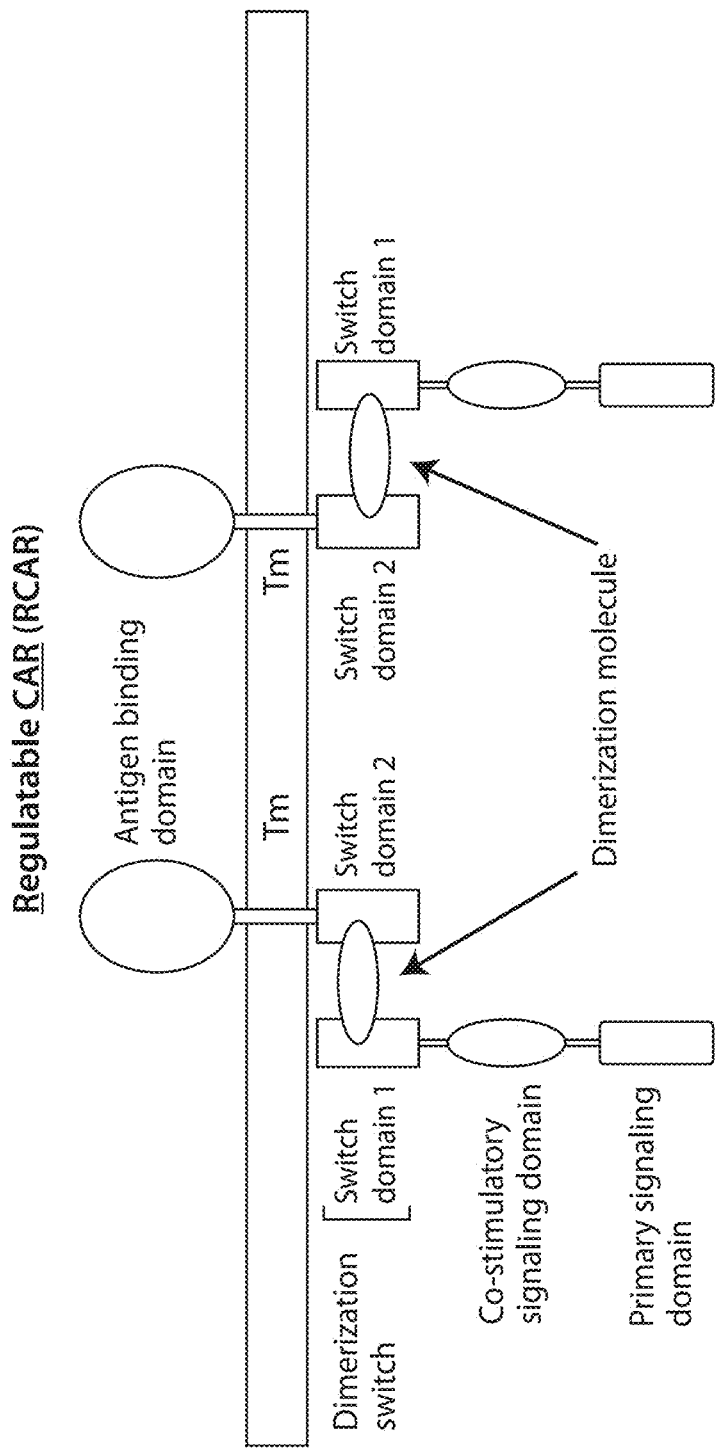
FIG. 42 depicts the structures of two exemplary RCAR configurations. The antigen binding members comprise an antigen binding domain, a transmembrane domain, and a switch domain. The intracellular binding members comprise a switch domain, a co-stimulatory signaling domain and a primary signaling domain. The two configurations demonstrate that the first and second switch domains described herein can be in different orientations with respect to the antigen binding member and the intracellular binding member. Other RCAR configurations are further described herein.

Non-transduced T cells failed to control the tumors, and all mice had to be euthanized due to disease progression 10-11 weeks after tumor injection (FIGS. 40A and 40C). In contrast, mice receiving CART-BCMA cells showed control of tumor growth in most mice resulting in 80% survival of CART-BCMA-treated mice at 10 weeks post-tumor cell inoculation compared with 0% survival of the NTD control-treated mice (FIGS. 40B and 40C). These results demonstrate that intramedullary RPMI 8226 tumors were inhibited by CART-BCMA treatment.

Example 14: BCMA-CART Dosing Scheme

A BCMA CART cell therapy, e.g., a BCMA CART cell therapy described herein, can be administered to patients, e.g., multiple myeloma patients, according to a dosing regimen described herein, e.g., a dosing regimen described as follows.

Leukopheresis is performed on the patient prior to receiving a BCMA CART therapy to obtain autologous T cells. Manufacturing and/or cryopreservation of the BCMA lenti-CAR T cells is performed. Patients may receive therapy during manufacturing to maintain disease control. Some patients may receive a lympho-depleting therapy (e.g., cytoxan) before CART cell administration. For example, a lympho-depleting chemotherapy, e.g., cytoxan (e.g., at 1.5 g/m$^2$) is administered to the patient. In other dosing regimens, a lympho-depleting chemotherapy is not administered to the patient. Patients are then treated with BCMA CART cells according to a dosing regimen described herein.

A dosing regimen involves dose fractionation, e.g., where a certain percentage of the total dose of cells is delivered on a first day of treatment, a different percentage of the total dose of cells is delivered on a subsequent day of treatment, and a different percentage of the total dose of cells is delivered on a yet subsequent day of treatment. For example, 10% of the total dose of cells is delivered on the first day, 30% of the total dose of cells is delivered on the second day, and the remaining 60% of the total dose of cells is delivered on the third day of treatment. For example, a total cell dose includes 1 to 5×10$^7$ or 1 to 5×10$^8$ BCMA-CART cells.

In one dosing regimen, no lympho-depleting chemotherapy is administered, and a total BCMA-CART cell dose of 1 to 5×10$^7$ is administered (e.g., by infusion) with 10% of the cell dose on day 1 of treatment, 30% on day 2 of treatment, and 60% on day 3 of treatment. In another dosing regimen, no lympho-depleting chemotherapy is administered, and a total BCMA-CART cell dose of 1 to 5×10$^8$ is administered (e.g., by infusion) with 10% of the cell dose on day 1 of treatment, 30% on day 2 of treatment, and 60% on day 3 of treatment. In another dosing regimen, a lympho-depleting chemotherapy (cytoxan at 1.5 g/m$^2$) is administered three days before BCMA-CART cell administration, and then a total BCMA-CART cell dose of 1 to 5×10$^7$ is administered (e.g., by infusion) with 10% of the cell dose on day 1 of treatment, 30% on day 2 of treatment, and 60% on day 3 of treatment. In yet another dosing regimen, a lympho-depleting chemotherapy (cytoxan at 1.5 g/m$^2$) is administered three days before BCMA-CART cell administration, and then a total BCMA-CART cell dose of 1 to 5×10$^8$ is administered (e.g., by infusion) with 10% of the cell dose on day 1 of treatment, 30% on day 2 of treatment, and 60% on day 3 of treatment.

Clinical lab assessments are performed on days 1, 2, 4, 7, 14, 21, 28, every 4 weeks, after CART cell administration (with day 0 being the first day of CART dosing). Multiple myeloma assessments are performed pre-CART dosing, on the first day of CART dosing (day 0), and days 14, 28, and every 4 weeks. Bone marrow aspirate/biopsy (bx) is performed pre-CART dosing, and on days 28 and 90 after CART dosing. After the first 28 days of CART treatment, follow-up is performed every 4 weeks up to 6 months, then every 3 months, up to 2 years.

Example 15: Low Dose RAD001 Stimulates CART Proliferation in a Cell Culture Model The effect of low doses of RAD001 on CAR T cell proliferation in vitro was evaluated by co-culturing CART-expressing cells with target cells in the presence of different concentrations of RAD001.

Materials and Methods

Generation of CAR-Transduced T Cells

A humanized, anti-human CD19 CAR (huCART19) lentiviral transfer vector was used to produce the genomic material packaged into VSVg pseudotyped lentiviral particles. The amino acid and nucleotide sequence of the humanized anti-human CD19 CAR (huCART19) is CAR 1, ID 104875 described in PCT publication, WO2014/153270, filed Mar. 15, 2014, and is designated SEQ ID NOs. 85 and 31 therein.

Lentiviral transfer vector DNA is mixed with the three packaging components VSVg env, gag/pol and rev in combination with lipofectamine reagent to transfect Lenti-X 293T cells. Medium is changed after 24 h and 30 h thereafter, the virus-containing media is collected, filtered and stored at −80° C. CARTs are generated by transduction of fresh or frozen naïve T cells obtained by negative magnetic selection of healthy donor blood or leukopak. T cells are activated by incubation with anti-CD3/anti-CD28 beads for 24 h, after which viral supernatant or concentrated virus (MOI=2 or 10, respectively) is added to the cultures. The modified T cells are allowed to expand for about 10 days. The percentage of cells transduced (expressing the CARs on the cell surface) and the level of CAR expression (relative fluorescence intensity, Geo Mean) are determined by flow cytometric analysis between days 7 and 9. The combination of slowing growth rate and T cell size approaching ~350 fL determines the state for T cells to be cryopreserved for later analysis.

Evaluating Proliferation of CARTs

To evaluate the functionality of CARTs, the T cells are thawed and counted, and viability is assessed by Cellometer.

The number of CAR-positive cells in each culture is normalized using non-transduced T cells (UTD). The impact of RAD001 on CARTs was tested in titrations with RAD001, starting at 50 nM. The target cell line used in all co-culture experiments is Nalm-6, a human pre-B cell acute lymphoblastic leukemia (ALL) cell line expressing CD19 and transduced to express luciferase.

For measuring the proliferation of CARTs, T cells are cultured with target cells at a ratio of 1:1. The assay is run for 4 days, when cells are stained for CD3, CD4, CD8 and CAR expression. The number of T cells is assessed by flow cytometry using counting beads as reference.

Results

Figure 43:
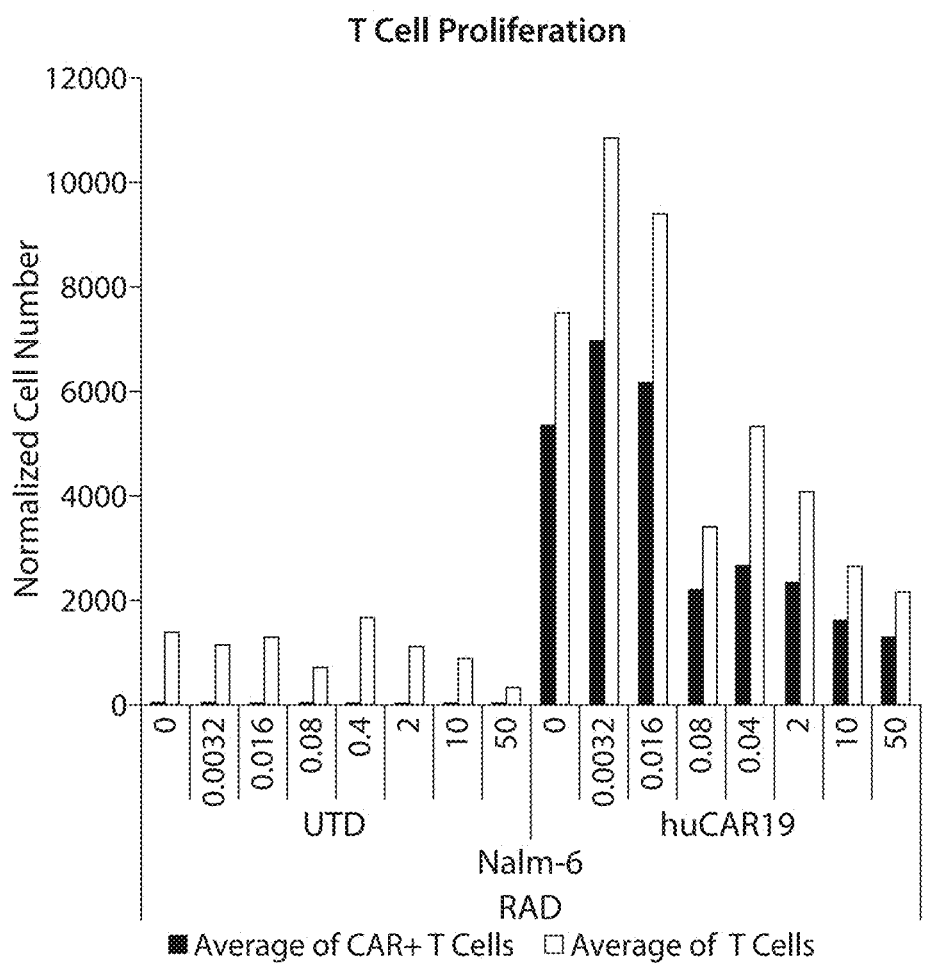
FIG. 43 shows that the proliferation of CAR-expressing, transduced T cells is enhanced by low doses of RAD001 in a cell culture system. CARTs were co-cultured with Nalm-6 cells in the presence of different concentrations of RAD001. The number of CAR-positive CD3-positive T cells (black) and total T cells (gray) was assessed after 4 days of co-culture.

The proliferative capacity of CART cells was tested in a 4 day co-culture assay. The number of CAR-positive CD3-positive T cells (dark bars) and total CD3-positive T cells (light bars) was assessed after culturing the CAR-transduced and non-transduced T cells with Nalm-6 (FIG. 43). huCART19 cells expanded when cultured in the presence of less than 0.016 nM of RAD001, and to a lesser extent at higher concentrations of the compound. Importantly, both at 0.0032 and 0.016 nM RAD001 the proliferation was higher than observed without the addition of RAD001. The non-transduced T cells (UTD) did not show detectable expansion.

Example 16: Low Dose RAD001 Stimulates CART Expansion In Vivo

This example evaluates the ability of huCAR19 cells to proliferate in vivo with different concentrations of RAD001.

Materials and Methods:

NALM6-Luc Cells:

The NALM6 human acute lymphoblastic leukemia (ALL) cell line was developed from the peripheral blood of a patient with relapsed ALL. The cells were then tagged with firefly luciferase. These suspension cells grow in RPMI supplemented with 10% heat inactivated fetal bovine serum.

Mice:

6 week old NSG (NOD.Cg-Prkdc$^{scid}$Il2rg$^{tm1Wjl}$/SzJ) mice were received from the Jackson Laboratory (stock number 005557).

Tumor Implantation:

NALM6-luc cells were grown and expanded in vitro in RPMI supplemented with 10% heat inactivated fetal bovine serum. The cells were then transferred to a 15 ml conical tube and washed twice with cold sterile PBS. NALM6-luc cells were then counted and resuspended at a concentration of $10 \times 10^6$ cells per milliliter of PBS. The cells were placed on ice and immediately (within one hour) implanted in the mice. NALM6-luc cells were injected intravenously via the tail vein in a 100 µl volume, for a total of $1 \times 10^6$ cells per mouse.

CAR T Cell Dosing:

Mice were administered $5 \times 10^6$ CAR T cells 7 days after tumor implantation. Cells were partially thawed in a 37 degree Celsius water bath and then completely thawed by the addition of 1 ml of cold sterile PBS to the tube containing the cells. The thawed cells were transferred to a 15 ml falcon tube and adjusted to a final volume of 10 mls with PBS. The cells were washed twice at 1000 rpm for 10 minutes each time and then counted on a hemocytometer. T cells were then resuspended at a concentration of $50 \times 10^6$ CAR T cells per ml of cold PBS and kept on ice until the mice were dosed. The mice were injected intravenously via the tail vein with 100 µl of the CAR T cells for a dose of $5 \times 10^6$ CAR T cells per mouse. Eight mice per group were treated either with 100 µl of PBS alone (PBS), or humanized CD19 CAR T cells.

RAD001 Dosing:

A concentrated micro-emulsion of 50 mg equal to 1 mg RAD001 was formulated and then resuspended in D5W (dextrose 5% in water) at the time of dosing. Mice were orally dosed daily (via oral gavage) with 200 µl of the desired doses of RAD001.

PK Analysis:

Mice were dosed daily with RAD001 starting 7 days post tumor implantation. Dosing groups were as follows: 0.3 mg/kg, 1 mg/kg, 3 mg/kg, and 10 mg/kg. Mice were bled on days 0 and 14 following the first and last dose of RAD001, at the following time points for PK analysis: 15 minutes, 30 minutes, 1 hour, 2 hours, 4 hours, 8 hours, 12 hours, and 24 hours.

Figure 44:
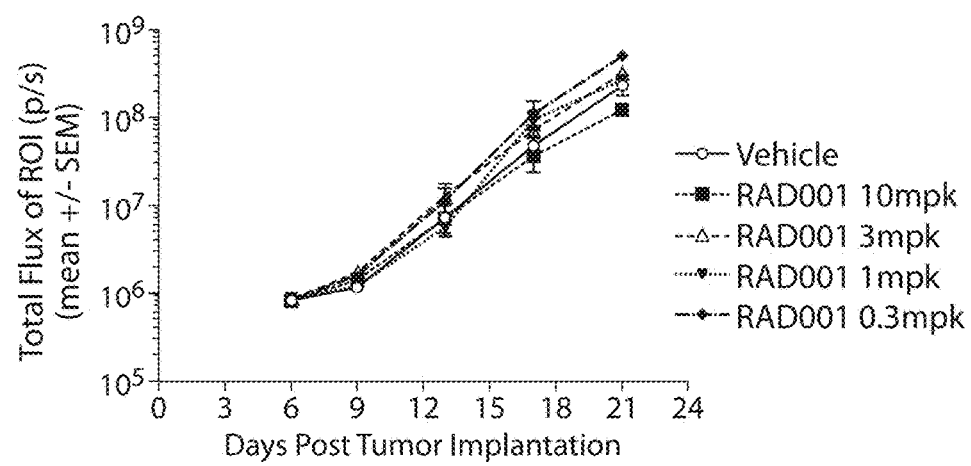
FIG. 44 depicts tumor growth measurements of NALM6-luc cells with daily RAD001 dosing at 0.3, 1, 3, and 10 mg/kg (mpk) or vehicle dosing. Circles denote the vehicle; squares denote the 10 mg/kg dose of RAD001; triangles denote the 3 mg/kg dose of RAD001, inverted triangles denote the 1 mg/kg dose of RAD001; and diamonds denote the 0.3 mg/kg dose of RAD001.
Figure 45A:
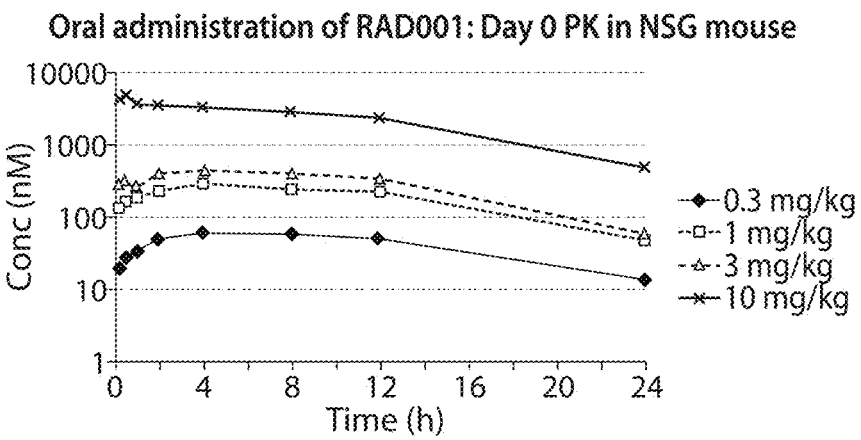
FIGS. 45A and 45B show pharmacokinetic curves showing the amount of RAD001 in the blood of NSG mice with NALM6 tumors.
Figure 45B:
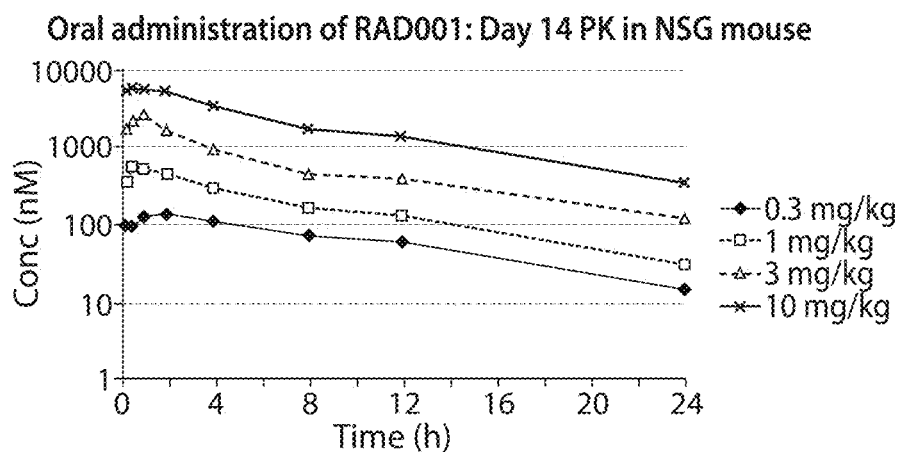

Results:

The expansion and pharmacokinetics of RAD001 was tested in NSG mice with NALM6-luc tumors. Daily oral dosing of RAD001 alone did not have an impact on the growth of NALM6-luc tumors (FIG. 44). The pharmacokinetic analysis of RAD001 shows that it is fairly stable in the blood of tumor bearing mice (FIGS. 45A and 45B). Both the day 0 and day 14 PK analyses show that the RAD001 concentrations in the blood is above 10 nm even 24 hours after dosing at the lowest dose tested (0.3 mg/kg).

Based on these doses, huCAR19 CAR T cells were dosed with and without RAD001 to determine the proliferative ability of these cells. The highest dose used was 3 mg/kg based on the levels of RAD001 in the blood 24 hours after dosing. As the concentration of RAD001 was above 10 nM 24 hours after the final dose of RAD001, several lower doses of RAD001 were used in the in vivo study with CAR T cells. The CAR T cells were dosed IV one day prior to the start of the daily oral RAD001 dosing. Mice were monitored via FACS for T cell expansion.

Figure 46A:
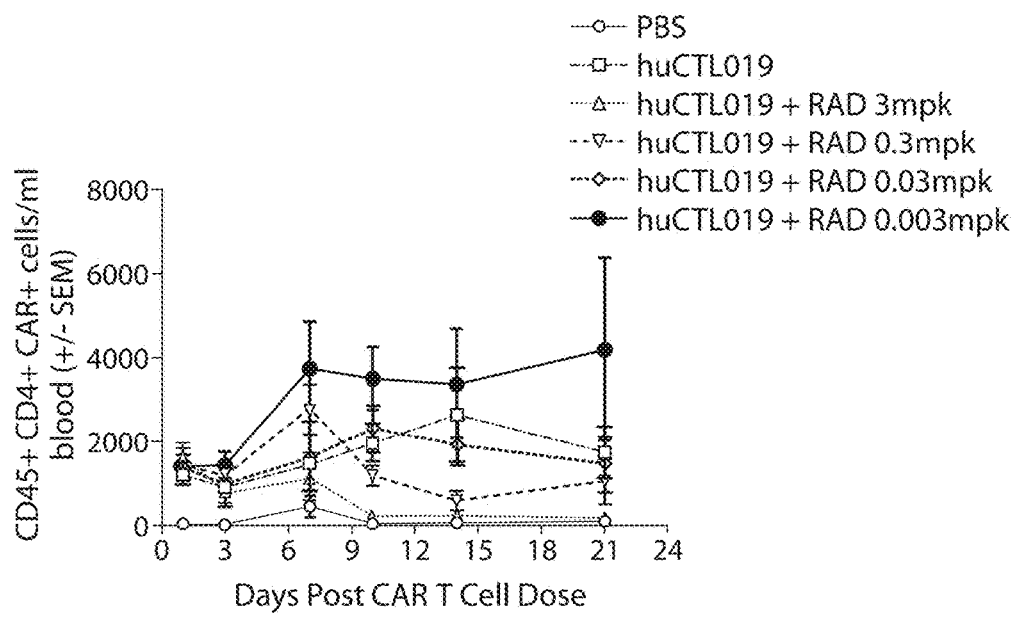
FIGS. 46A and 46B show in vivo proliferation of humanized CD19 CART cells with and without RAD001 dosing. Low doses of RAD001 (0.003 mg/kg) daily lead to an enhancement in CAR T cell proliferation, above the normal level of huCAR19 proliferation.
Figure 46B:
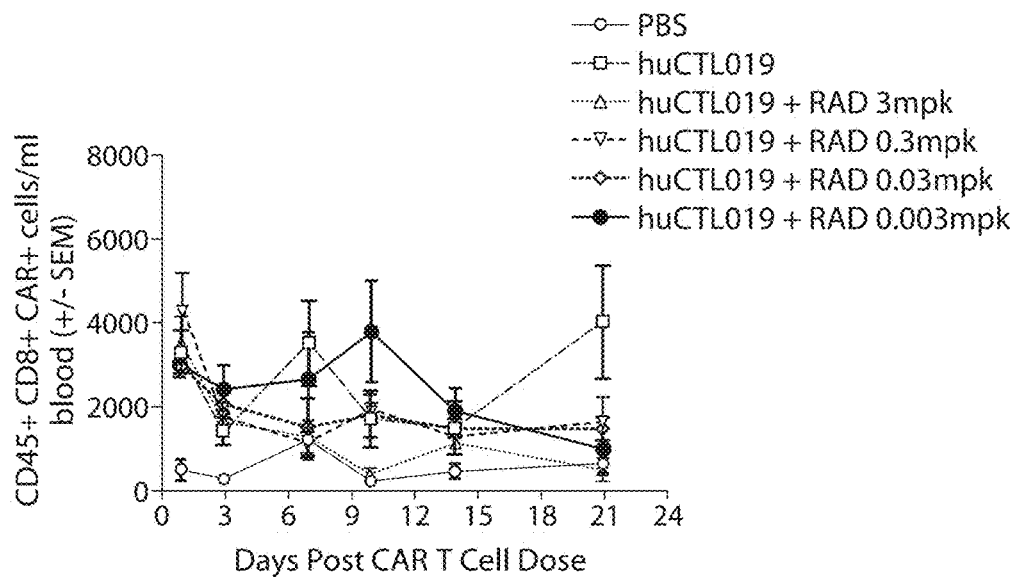

The lowest doses of RAD001 show an enhanced proliferation of the CAR T cells (FIGS. 46A-46B). This enhanced proliferation is more evident and prolonged with the CD4$^+$ CAR T cells than the CD8$^+$ CAR T cells. However, with the CD8$^+$ CAR T cells, enhanced proliferation can be seen at early time points following the CAR T cell dose.

Example 17: CD19 CAR T Cells for Use in Treating Multiple Myeloma

Even with current regimens of chemotherapy, targeted therapies, and autologous stem cell transplant, myeloma is considered an incurable disease. The present example describes treating multiple myeloma (MM) with autologous T cells directed to CD19 with a chimeric antigen receptor (lentivirus/CD19:4-1BB:CD3zeta; also known as "CART19" or CTL019). This example demonstrates that CD19-directed CAR therapies have the potential to establish deep, long-term durable remissions based on targeting the myeloma stem cell and/or tumor cells that express very low (undetectable by most methods) levels of CD19.

In treating a patient with an aggressive secondary plasma cell leukemia, we found that CART19 administered two days after a salvage autologous stem cell transplant resulted in rapid clearance of plasma cell leukemia and a very good partial response in a patient who had progressed through multiple lines of chemotherapy. This patient was transfusion-dependent for months prior to the treatment; at two months after the treatment, she has recovered her blood counts (with normal-range platelet counts and white blood cell counts) and has not required transfusions since she was discharged from the hospital from her treatment.

Because myeloma cells do not naturally express CD19, the finding that CART19 treatment induced a rapid and significant tumor response in this tumor was surprising. Without wishing to be bound by a particular theory, it was reasoned that CART19 could be used to treat myeloma because: (1) while myeloma cells are traditionally thought to be negative for CD19 expression by flow cytometry, there are data indicating that myeloma cells may express very low levels of CD19, such that expression is detectable by RNA but not by flow cytometry or immunohistochemistry; and (2) the concept of targeting the clonotypic B cell, which is thought to be the cancerous stem cell that gives rise to multiple myeloma, and is particularly resistant to chemotherapy. There is a clonal relationship between B cells and myeloma tumor cells, but traditional myeloma therapy is aimed at the malignant plasma cells rather than B cells. CART19 for treating myeloma therefore targets a different cell population than most myeloma therapies.

Figure 47:
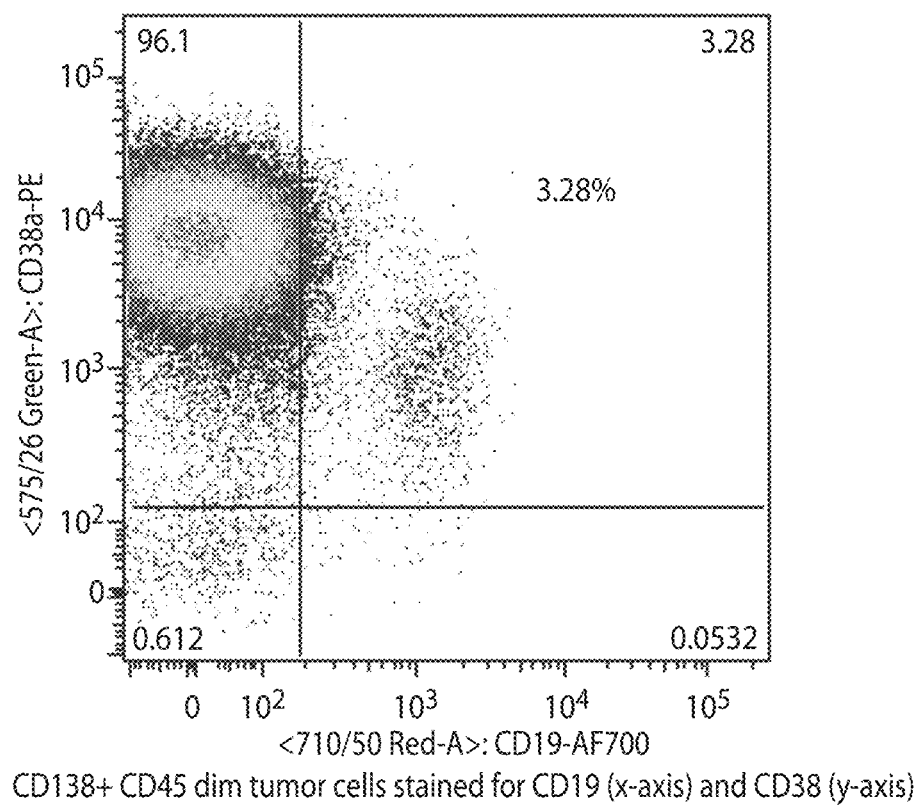
FIG. 47 depicts CD19 expression in a patient's tumor cells. CD138+ CD45$^{dim}$ tumor cells were stained for CD19 (x-axis) and CD38 (y-axis). Approximately 1-2% of the tumor cells expressed the CD19 antigen.

In our single patient experience, the patient had circulating plasma cells, and we were able to test her tumor cells for the expression of CD19. Approximately 1-2% of her tumor cells expressed the CD19 antigen. (FIG. 47). Thus, it was reasoned that CART19 may have a direct effect on a very small population of her tumor cells; a very good partial response, though would not have been predicted based on targeting only the very small population of CD19+ tumor cells.

In this case, CART19 was administered following autologous stem cell transplant rescue after high-dose melphalan. Although this is a standard therapy in myeloma, it is not curative. Furthermore, this patient had previously undergone tandem autologous stem cell transplants and relapsed early (<6 months) after transplant. Without wishing to be bound by a particular theory, use of CART19 cells as described in the present example may have a non-overlapping mechanism in the treatment of myeloma when combined with a salvage autologous stem cell transplant.

A patient with refractory multiple myeloma was treated with CTL019 after myeloablative chemotherapy and ASCT. Remission was maintained despite loss of detectable CTL019 and reconstitution of normal CD19-positive B cells, indicating that this response did not require sustained CTL019 activity. Moreover, this patient's response was realized even though the vast majority (99.95%) of the neoplastic plasma cells were CD19-negative by both flow cytometry and RT-PCR.

The absence of detectable CD19 expression in this patient's dominant neoplastic plasma cell population suggests that the clinically relevant target of CTL019 resided outside this dominant CD19-negative population. Neoplastic plasma cells in multiple myeloma patients exhibit genetic, immunophenotypic, and functional heterogeneity. Particular subpopulations may be required for survival of the clone through anti-myeloma therapy. In the patient reported here, for example, the small CD19-expressing subset of plasma cells might have been relatively melphalan-resistant but sensitive to CTL019. This finding suggests that therapeutically targeting a small subset of the clone can lead to durable clinical benefit when coupled with conventional anti-myeloma therapy.

Alternatively, the clinically relevant target of CTL019 in this patient may have resided outside the neoplastic plasma cell population. For instance, the CTL019 may target a stem cell population that is relatively small but gives rise to neoplastic plasma cells. Multiple myeloma may therefore be a disease of multiple late B-lineage cell types, not just terminally differentiated plasma cells, such that therapies like CTL019 that target B lymphocytes might be useful adjuncts to therapies that directly target plasma cells.

Ten additional multiple myeloma patients will be treated with CART19 in a Phase I trial, at least three patients have been treated to date.

Dose Rationale

With the first 3 patients, we have observed clinical activity at doses ranging from $1.4 \times 10^7$ to $1.1 \times 10^9$ CART-19 cells. This observation demonstrates, at least in the first 3 patients treated, that there is not an obvious dose response relationship. A complete response was observed in patients administered with two log fold difference in dose. Thus, unlike standard drugs that are metabolized, CAR T cells can have a wide dose response range. This is most likely because the CAR T cells are able to proliferate extensively in the patients. We therefore set a dose range of $1-5 \times 10^8$ CART-19 cells for infusion. In this single-patient study offered on a compassionate use basis, the patient was offered up to $5 \times 10^8$ CART19 cells, with no lower dose limit. For the ten patient trial, patients will be offered $1-5 \times 10^7$ CART-19 cells.

General Design

This was single patient-study offered on a compassionate use basis; it was modeled after a Phase I study to determine if the infusion of autologous T cells transduced to express CART-19 is safe. The primary goals of the study were to determine the safety, tolerability and engraftment potential of CART-19 T cells in patients undergoing salvage ASCT after early relapse following first ASCT. The protocol consists of an open label pilot study.

At entry subjects will undergo a bone marrow biopsy and routine laboratory and imaging assessment of their MM. Eligible subjects will undergo steady-state apheresis to obtain large numbers of peripheral blood mononuclear cells (PBMC) for CART-19 manufacturing. The T cells will be purified from the PBMC, transduced with TCRζ/4-1BB lentiviral vector, expanded in vitro and then frozen for future administration. The number of patients who have inadequate T cell collections, expansion or manufacturing compared to the number of patients who have T cells successfully manufactured will be recorded; feasibility of product manufacturing is not expected to be problematic in this patient population.

Subjects will generally have had adequate peripheral blood stem cells remaining stored from the mobilization/collection performed in preparation for their first ASCT to conduct two additional ASCT. Those who do not will undergo a second mobilization/collection procedure either before or after their steady-state apheresis with a regimen according to the treating physician's preference. Approximately two weeks after the initial leukapheresis, subjects will be admitted to the hospital and receive high-dose melphalan (day −2) followed by infusion of autologous stem cells two days later (day 0), and all subjects will receive infusion of CART-19 cells twelve to fourteen days later (day +12-14). Up to 10 patients will be enrolled.

All subjects will have blood tests to assess safety, and engraftment and persistence of the CART-19 cells at regular intervals through week 4 of the study. At day +42 and day +100, subjects will undergo bone marrow aspirates/biopsies to assess the bone marrow plasma cell burden and trafficking of CART-19 cells to the bone marrow. A formal response assessment will be made at day 100 according to International Myeloma Working Group (IMWG) criteria 136, and TTP will be monitored according to routine clinical practice for patients with multiple myeloma. The main efficacy outcome measured in this study will be a comparison of TTP after a patient's initial ASCT to TTP after the ASCT on this study.

Treatment Regimen

Therapy for Relapsed/Progressive Multiple Myeloma

Patients may receive, prior to enrollment, therapy for relapsed/progressive multiple myeloma according to the preference of their treating physicians. Therapy may continue upon enrollment.

Patients must stop all therapy for two weeks prior to apheresis and for two weeks prior to high-dose melphalan. If more than two weeks are expected to lapse between apheresis and high-dose melphalan, patients may resume therapy after apheresis at the discretion of their treating physicians.

High-Dose Melphalan (Day −2)

Patients will be admitted to the hospital on day −3 or −2 and will undergo examination by the attending physician and routine laboratory tests, which will include monitoring parameters for tumor lysis syndrome, prior to commencement of the treatment protocol. Blood for MM monitoring laboratory tests (SPEP, quantitative immunoglobulins, and serum free light chain analysis), will be drawn prior to initiation of therapy if such tests had not been drawn within 7 days of admission.

High-dose therapy will consist of melphalan at a dose of 200 mg/m$^2$ administered intravenously over approximately 20 minutes on day −2. The dose of melphalan will be reduced to 140 mg/m$^2$ for patients >70 years of age or for patients of any age whom, at the discretion of the treating physician, may not tolerate a dose of 200 mg/m$^2$ All patients will receive standard anti-emetic prophylaxis, which may include dexamethasone, and standard antibiotic prophylaxis.

Stem-Cell Re-Infusion (Day 0)

Stem cell infusion will take place on day 0, at least 18 hours after the administration of the high-dose melphalan. Stem cells will be infused intravenously over approximately 20-60 minutes following premedication according to standard institutional practice. At least 2×10$^6$ CD34+ progenitors/kg body weight should be infused. In addition, at least 1×10$^6$ CD34+ progenitors/kg body weight should be available as a back-up stem-cell product to be infused in the event of delayed engraftment or late graft failure. G-CSF should be administered SQ beginning on day +5, dosed according to standard institutional practice. Other supportive care measures such as transfusion support will be done in accordance with standard institutional guidelines.

CART19 Cell Infusion (Day +12-14)

A single dose of CART-19 transduced T cells will be given consisting of up to 5×10$^7$ CART-19 cells. The minimal acceptable dose for infusion of cells transduced with the CD19 TCRζ-4-1BB vector is 1×10$^7$. CART-19 cells will be given as a single dose by rapid i.v. infusion on day +12-14 after stem cell infusion. If patient fails to meet any of the inclusion criteria described herein in the 12-14 day window, the CART-19 infusion may be delayed beyond day +12-14 until the criteria is satisfied.

Maintenance Lenalidomide

Subjects who received and tolerated maintenance lenalidomide after their first ASCT will re-initiate lenalidomide maintenance therapy at approximately day +100, assuming there are no contraindications in the judgment of the treating physician. The starting dose will be 10 mg daily unless prior experience dictates an alternative starting dose for a particular patient. Maintenance therapy will continue until disease progression or intolerance.

Administration of Study Drug

The infusion will take place in an isolated room in Rhoads, using precautions for immunosuppressed patients. The transduced T cells will be administered by rapid intravenous infusion at a flow rate of approximately 10 mL to 20 ml per minute through an 18-gauge latex free Y-type blood set with a 3-way stopcock. The duration of the infusion will be based on the total volume to be infused and the recommended infusion rate. Each infusion bag will have affixed to it a label containing the following: "FOR AUTOLOGOUS USE ONLY." In addition the label will have at least two unique identifiers such as the subject's initials, birth date, and study number. Prior to the infusion, two individuals will independently verify all this information in the presence of the subject and so confirm that the information is correctly matched to the participant.

Packaging

Infusion will be comprised of a single dose of 1-5×10$^7$ CA T19-transduced cells, with a minimal acceptable dose of 1×10$^7$ CART-19 cells for infusion. Each bag will contain an aliquot (volume dependent upon dose) of cryomedia containing the following infusible grade reagents (% v/v): 31.25% plasmalyte-A, 31.25% dextrose (5%), 0.45% NaCl, up to 7.5% DMSO, 1% dextran 40, 5% human serum albumin.

Apheresis

A large volume (12-15 liters or 4-6 blood volumes) apheresis procedure is carried out at the apheresis center. PBMC are obtained for CART-19 during this procedure. From a single leukapheresis, the intention is to harvest at least 5×10$^9$ white blood cells to manufacture CART-19 T cells. Baseline blood leukocytes for FDA look-back requirements and for research are also obtained and cryopreserved. The cell product is expected to be ready for release approximately 2-4 weeks later. Flow cytometry lymphocyte subset quantitation, including CD19 and CD20 B cell determination. Baseline assessment is made for human anti-VSV-G and anti-murine antibody (HAMA). If a subject has previously had an adequate apheresis collection banked according to current Good Manufacturing Practices at the Clinical Cell and Vaccine Production Facility these cells may be used as the source of cells for CART-19 manufacturing. Using a banked apheresis product would avert the expense, time, and risk to the subject of undergoing an additional apheresis collection.

Cytoreductive Chemotherapy

The lymphodepleting chemotherapy will be high-dose melphalan as described herein.

CART-19 Infusion

Infusion will begin on day +12-14 after stem-cell reinfusion.

On day +12-14 prior to the first infusion, patients will have a CBC with differential, and assessment of CD3, CD4 and CD8 counts since chemotherapy is given in part to induce lymphopenia.

The first dose will be administered using a single dose. The cells are thawed at the patient's bedside. The thawed cells will be given at as rapid an infusion rate as tolerated such that the duration of the infusion will be approximately 1 0-15 minutes. In order to facilitate mixing, the cells will be administered simultaneously using a Y-adapter. Subjects will be infused and premedicated as described herein. Subjects' vital signs will be assessed and pulse oxymetry done prior to dosing, at the end of the infusion, and every 15 minutes thereafter for 1 hour and until these are stable and satisfactory. A blood sample for determination of a baseline CART-19 level is obtained any time prior to the first infusion and 20 minutes to 4 hours after each infusion (and sent to TCSL).

Results

Three treatment-refractory, advanced multiple myeloma patients have now been treated with CTL019 in this ongoing trial. Results for two of these patients show that both have had substantial anti-tumor effects from the CTL019 therapy based on the primary efficacy assessment at the three-month time-point. The third patient has not yet reached the three-month time point. The results for the two patients are described in more detail below.

The first myeloma patient has completed her +100 day response assessment and she had a very good response to the CART19 therapy. The following tests were performed with the following results:

SPEP/immunofixation: negative
urine immunofixation: faint unmeasurable kappa light chain band on her immunofixation (also present at day 38, so not new)
Otherwise, the patient met the criteria for stringent complete remission including:
serum free light chain ratio: normal
bone marrow biopsy: negative
IgA immunophenotyping: IgA is below the limit of detection Other than the faint unmeasurable kappa light chain result from urine immunofixation, the patient met all criteria for "stringent complete remission". The summary of the plasma cell immunophenotyping at 3 time points (day −2, day +38, day +103) is shown in FIGS. 39A-39C, and demonstrates that the patient's IgA is below the limit of detection. The summary shows heavy myeloma burden at day −2 and none detectable at day +38 and +103, which classifies the patient as "MRD negative" by flow analysis. At day +103, the summary shows recovery of normal, polyclonal, CD19+ plasma cells and B cells. The patient had no symptoms of disease or therapy and is functioning like a normal person.

The second patient treated has not yet reached the +100 day time point. However, at this time point, she is doing well but it is too early to determine the effect of the CTL019 infusion.

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (1117 sequences)

SEQ ID NO: 1 - protein, 21 aa, Artificial Sequence
  Description of Artificial Sequence: Synthetic peptide
MALPVTALLLPLALLLHAARP

SEQ ID NO: 2 - protein, 45 aa, Artificial Sequence
  Description of Artificial Sequence: Synthetic polypeptide
TTTPAPRPPTPAPTIASQPLSLRPEACRPAAGGAVHTRGLDFACD

SEQ ID NO: 3 - protein, 230 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 4 - protein, 282 aa, Artificial Sequence
  Description of Artificial Sequence: Synthetic polypeptide
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 5 - protein, 10 aa, Artificial Sequence
  Description of Artificial Sequence: Synthetic peptide
GGGGSGGGGS

SEQ ID NO: 6 - protein, 24 aa, Artificial Sequence
  Description of Artificial Sequence: Synthetic peptide
IYIWAPLAGTCGVLLLSLVITLYC

SEQ ID NO: 7 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 8 - protein, 48 aa, Artificial Sequence
  Description of Artificial Sequence: Synthetic polypeptide
QRRKYRSNKGESPVEPAEPCRYSCPREEEGSTIPIQEDYRKPEPACSP

SEQ ID NO: 9 - protein, 112 aa, Artificial Sequence
  Description of Artificial Sequence: Synthetic polypeptide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11 - DNA, 1184 bp, Artificial Sequence
  Description of Artificial Sequence: Synthetic polynucleotide
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 12 - DNA, 63 bp, Artificial Sequence
  Description of Artificial Sequence: Synthetic oligonucleotide
atggccctgcctgtgacagccctgctgctgcctctggctctgctgctgcatgccgctagaccc

SEQ ID NO: 13 - DNA, 135 bp, Artificial Sequence
  Description of Artificial Sequence: Synthetic polynucleotide
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 14 - DNA, 690 bp, Artificial Sequence
  Description of Artificial Sequence: Synthetic polynucleotide
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 15 - DNA, 847 bp, Artificial Sequence
  Description of Artificial Sequence: Synthetic polynucleotide
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 16 - DNA, 30 bp, Artificial Sequence
  Description of Artificial Sequence: Synthetic oligonucleotide
ggtggcggaggttctggaggtggaggttcc

SEQ ID NO: 17 - DNA, 72 bp, Artificial Sequence
  Description of Artificial Sequence: Synthetic oligonucleotide
atctacatctgggcgcccttggccgggacttgtggggtccttctcctgtcactggttatcaccctttactgc

SEQ ID NO: 18 - DNA, 126 bp, Artificial Sequence
  Description of Artificial Sequence: Synthetic polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 19 - DNA, 123 bp, Artificial Sequence
  Description of Artificial Sequence: Synthetic polynucleotide
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 20 - DNA, 336 bp, Artificial Sequence
  Description of Artificial Sequence: Synthetic polynucleotide
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 21 - DNA, 336 bp, Homo sapiens
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 373 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 23 - DNA, 1182 bp, Artificial Sequence
  Description of Artificial Sequence: Synthetic polynucleotide
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 24 - protein, 394 aa, Artificial Sequence
  Description of Artificial Sequence: Synthetic polypeptide
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 25 - protein, 5 aa, Artificial Sequence
  Description of Artificial Sequence: Synthetic peptide
GGGGS

SEQ ID NO: 26 - protein, 30 aa, Artificial Sequence
  Description of Artificial Sequence: Synthetic polypeptide
  MISC_FEATURE (1)..(30): This sequence may encompass 1-6 'Gly Gly Gly Gly Ser' repeating units, wherein some positions may be absent
  See specification as filed for detailed description of substitutions and preferred embodiments
GGGGSGGGGSGGGGSGGGGSGGGGSGGGGS

SEQ ID NO: 27 - protein, 20 aa, Artificial Sequence
  Description of Artificial Sequence: Synthetic peptide
GGGGSGGGGSGGGGSGGGGS

SEQ ID NO: 28 - protein, 15 aa, Artificial Sequence
  Description of Artificial Sequence: Synthetic peptide
GGGGSGGGGSGGGGS

SEQ ID NO: 29 - protein, 4 aa, Artificial Sequence
  Description of Artificial Sequence: Synthetic peptide
GGGS

SEQ ID NO: 30 - DNA, 5000 bp, Artificial Sequence
  Description of Artificial Sequence: Synthetic polynucleotide
  misc_feature (1)..(5000): This sequence may encompass 50-5,000 nucleotides, wherein some positions may be absent
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 100 bp, Artificial Sequence
  Description of Artificial Sequence: Synthetic polynucleotide
tttttttttttttttttttttttttttttttttttttttttttttttttttttttttttttttttttttttttttttttttttttttttttttttttttt

SEQ ID NO: 32 - DNA, 5000 bp, Artificial Sequence
  Description of Artificial Sequence: Synthetic polynucleotide
  misc_feature (1)..(5000): This sequence may encompass 50-5,000 nucleotides, wherein some positions may be absent
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 33 - DNA, 5000 bp, Artificial Sequence; identical to SEQ ID NO: 30
  Description of Artificial Sequence: Synthetic polynucleotide
  misc_feature (1)..(5000): This sequence may encompass 100-5,000 nucleotides, wherein some positions may be absent

SEQ ID NO: 34 - DNA, 400 bp, Artificial Sequence
  Description of Artificial Sequence: Synthetic polynucleotide
  misc_feature (1)..(400): This sequence may encompass 100-400 nucleotides, wherein some positions may be absent
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 2000 bp, Artificial Sequence
  Description of Artificial Sequence: Synthetic polynucleotide
  misc_feature (1)..(2000): This sequence may encompass 50-2,000 nucleotides, wherein some positions may be absent
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 36 - protein, 230 aa, Artificial Sequence; identical to SEQ ID NO: 3
  Description of Artificial Sequence: Synthetic polypeptide

SEQ ID NO: 37 - DNA, 690 bp, Artificial Sequence; identical to SEQ ID NO: 14
  Description of Artificial Sequence: Synthetic polynucleotide

SEQ ID NO: 38 - protein, 40 aa, Artificial Sequence
  Description of Artificial Sequence: Synthetic polypeptide
  MISC_FEATURE (1)..(40): This sequence may encompass 1-10 'Gly Gly Gly Ser' repeating units, wherein some positions may be absent
  See specification as filed for detailed description of substitutions and preferred embodiments
GGGSGGGSGGGSGGGSGGGSGGGSGGGSGGGSGGGSGGGS

SEQ ID NO: 39 - protein, 246 aa, Artificial Sequence
  Description of Artificial Sequence: Synthetic polypeptide
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 40 - protein, 244 aa, Artificial Sequence
  Description of Artificial Sequence: Synthetic polypeptide
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 41 - protein, 243 aa, Artificial Sequence
  Description of Artificial Sequence: Synthetic polypeptide
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 42 - protein, 249 aa, Artificial Sequence
  Description of Artificial Sequence: Synthetic polypeptide
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 43 - protein, 246 aa, Artificial Sequence
  Description of Artificial Sequence: Synthetic polypeptide
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 44 - protein, 247 aa, Artificial Sequence
  Description of Artificial Sequence: Synthetic polypeptide
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 45 - protein, 238 aa, Artificial Sequence
  Description of Artificial Sequence: Synthetic polypeptide
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 46 - protein, 239 aa, Artificial Sequence
  Description of Artificial Sequence: Synthetic polypeptide
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 47 - protein, 241 aa, Artificial Sequence
  Description of Artificial Sequence: Synthetic polypeptide
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 48 - protein, 239 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 49 - protein, 239 aa, Artificial Sequence
  Description of Artificial Sequence: Synthetic polypeptide
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 50 - protein, 246 aa, Artificial Sequence
  Description of Artificial Sequence: Synthetic polypeptide
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 51 - protein, 239 aa, Artificial Sequence
  Description of Artificial Sequence: Synthetic polypeptide
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 52 - protein, 240 aa, Artificial Sequence
  Description of Artificial Sequence: Synthetic polypeptide
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 53 - protein, 241 aa, Artificial Sequence
  Description of Artificial Sequence: Synthetic polypeptide
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 54 - DNA, 738 bp, Artificial Sequence
  Description of Artificial Sequence: Synthetic polynucleotide
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 55 - DNA, 732 bp, Artificial Sequence
  Description of Artificial Sequence: Synthetic polynucleotide
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 56 - DNA, 729 bp, Artificial Sequence
  Description of Artificial Sequence: Synthetic polynucleotide
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 57 - DNA, 747 bp, Artificial Sequence
  Description of Artificial Sequence: Synthetic polynucleotide
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 58 - DNA, 738 bp, Artificial Sequence
  Description of Artificial Sequence: Synthetic polynucleotide
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 59 - DNA, 741 bp, Artificial Sequence
  Description of Artificial Sequence: Synthetic polynucleotide
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 60 - DNA, 714 bp, Artificial Sequence
  Description of Artificial Sequence: Synthetic polynucleotide
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 61 - DNA, 717 bp, Artificial Sequence
  Description of Artificial Sequence: Synthetic polynucleotide
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 62 - DNA, 723 bp, Artificial Sequence
  Description of Artificial Sequence: Synthetic polynucleotide
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 63 - DNA, 717 bp, Artificial Sequence
  Description of Artificial Sequence: Synthetic polynucleotide
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 64 - DNA, 717 bp, Artificial Sequence
  Description of Artificial Sequence: Synthetic polynucleotide
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 65 - DNA, 738 bp, Artificial Sequence
  Description of Artificial Sequence: Synthetic polynucleotide
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 66 - DNA, 717 bp, Artificial Sequence
  Description of Artificial Sequence: Synthetic polynucleotide
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 67 - DNA, 720 bp, Artificial Sequence
  Description of Artificial Sequence: Synthetic polynucleotide
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 68 - DNA, 723 bp, Artificial Sequence
  Description of Artificial Sequence: Synthetic polynucleotide
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 69 - protein, 120 aa, Artificial Sequence
  Description of Artificial Sequence: Synthetic polypeptide
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 70 - protein, 115 aa, Artificial Sequence
  Description of Artificial Sequence: Synthetic polypeptide
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 71 - protein, 115 aa, Artificial Sequence
  Description of Artificial Sequence: Synthetic polypeptide
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 72 - protein, 120 aa, Artificial Sequence
  Description of Artificial Sequence: Synthetic polypeptide
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 73 - protein, 123 aa, Artificial Sequence
  Description of Artificial Sequence: Synthetic polypeptide
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 74 - protein, 118 aa, Artificial Sequence
  Description of Artificial Sequence: Synthetic polypeptide
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 75 - protein, 115 aa, Artificial Sequence
  Description of Artificial Sequence: Synthetic polypeptide
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 76 - protein, 115 aa, Artificial Sequence
  Description of Artificial Sequence: Synthetic polypeptide
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 77 - protein, 115 aa, Artificial Sequence
  Description of Artificial Sequence: Synthetic polypeptide
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 78 - protein, 117 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 79 - protein, 115 aa, Artificial Sequence
  Description of Artificial Sequence: Synthetic polypeptide
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 80 - protein, 117 aa, Artificial Sequence
  Description of Artificial Sequence: Synthetic polypeptide
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 81 - protein, 115 aa, Artificial Sequence
  Description of Artificial Sequence: Synthetic polypeptide
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 82 - protein, 115 aa, Artificial Sequence; identical to SEQ ID NO: 76
  Description of Artificial Sequence: Synthetic polypeptide

SEQ ID NO: 83 - protein, 115 aa, Artificial Sequence; identical to SEQ ID NO: 79
  Description of Artificial Sequence: Synthetic polypeptide

SEQ ID NO: 84 - protein, 109 aa, Artificial Sequence
  Description of Artificial Sequence: Synthetic polypeptide
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 85 - protein, 112 aa, Artificial Sequence
  Description of Artificial Sequence: Synthetic polypeptide
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 86 - protein, 111 aa, Artificial Sequence
  Description of Artificial Sequence: Synthetic polypeptide
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 87 - protein, 112 aa, Artificial Sequence
  Description of Artificial Sequence: Synthetic polypeptide
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 88 - protein, 106 aa, Artificial Sequence
  Description of Artificial Sequence: Synthetic polypeptide
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 89 - protein, 112 aa, Artificial Sequence
  Description of Artificial Sequence: Synthetic polypeptide
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 90 - protein, 106 aa, Artificial Sequence
  Description of Artificial Sequence: Synthetic polypeptide
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 91 - protein, 107 aa, Artificial Sequence
  Description of Artificial Sequence: Synthetic polypeptide
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 92 - protein, 109 aa, Artificial Sequence
  Description of Artificial Sequence: Synthetic polypeptide
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 93 - protein, 105 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 94 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 95 - protein, 112 aa, Artificial Sequence
  Description of Artificial Sequence: Synthetic polypeptide
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 96 - protein, 107 aa, Artificial Sequence
  Description of Artificial Sequence: Synthetic polypeptide
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 97 - protein, 108 aa, Artificial Sequence
  Description of Artificial Sequence: Synthetic polypeptide
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 98 - protein, 109 aa, Artificial Sequence
  Description of Artificial Sequence: Synthetic polypeptide
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 99 - protein, 490 aa, Artificial Sequence
  Description of Artificial Sequence: Synthetic polypeptide
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 100 - protein, 488 aa, Artificial Sequence
  Description of Artificial Sequence: Synthetic polypeptide
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 101 - protein, 487 aa, Artificial Sequence
  Description of Artificial Sequence: Synthetic polypeptide
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 102 - protein, 493 aa, Artificial Sequence
  Description of Artificial Sequence: Synthetic polypeptide
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 103 - protein, 490 aa, Artificial Sequence
  Description of Artificial Sequence: Synthetic polypeptide
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 104 - protein, 491 aa, Artificial Sequence
  Description of Artificial Sequence: Synthetic polypeptide
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 105 - protein, 482 aa, Artificial Sequence
  Description of Artificial Sequence: Synthetic polypeptide
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 106 - protein, 483 aa, Artificial Sequence
  Description of Artificial Sequence: Synthetic polypeptide
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 107 - protein, 485 aa, Artificial Sequence
  Description of Artificial Sequence: Synthetic polypeptide
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 108 - protein, 483 aa, Artificial Sequence
  Description of Artificial Sequence: Synthetic polypeptide
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 109 - protein, 483 aa, Artificial Sequence
  Description of Artificial Sequence: Synthetic polypeptide
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 110 - protein, 490 aa, Artificial Sequence
  Description of Artificial Sequence: Synthetic polypeptide
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 111 - protein, 483 aa, Artificial Sequence
  Description of Artificial Sequence: Synthetic polypeptide
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 112 - protein, 484 aa, Artificial Sequence
  Description of Artificial Sequence: Synthetic polypeptide
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 113 - protein, 485 aa, Artificial Sequence
  Description of Artificial Sequence: Synthetic polypeptide
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 114 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 115 - DNA, 1464 bp, Artificial Sequence
  Description of Artificial Sequence: Synthetic polynucleotide
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 116 - DNA, 1461 bp, Artificial Sequence
  Description of Artificial Sequence: Synthetic polynucleotide
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 117 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 118 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 119 - DNA, 1473 bp, Artificial Sequence
  Description of Artificial Sequence: Synthetic polynucleotide
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 120 - DNA, 1446 bp, Artificial Sequence
  Description of Artificial Sequence: Synthetic polynucleotide
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 121 - DNA, 1449 bp, Artificial Sequence
  Description of Artificial Sequence: Synthetic polynucleotide
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 122 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 123 - DNA, 1449 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 124 - DNA, 1449 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 125 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 126 - DNA, 1449 bp, Artificial Sequence
  Description of Artificial Sequence: Synthetic polynucleotide
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 127 - DNA, 1452 bp, Artificial Sequence
  Description of Artificial Sequence: Synthetic polynucleotide
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 128 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 129 - protein, 243 aa, Artificial Sequence
  Description of Artificial Sequence: Synthetic polypeptide
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 130 - protein, 244 aa, Artificial Sequence
  Description of Artificial Sequence: Synthetic polypeptide
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 131 - protein, 246 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 132 - protein, 240 aa, Artificial Sequence
  Description of Artificial Sequence: Synthetic polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 133 - protein, 241 aa, Artificial Sequence
  Description of Artificial Sequence: Synthetic polypeptide
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 134 - protein, 245 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 135 - protein, 253 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 136 - protein, 248 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 137 - protein, 246 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 138 - protein, 241 aa, Artificial Sequence
  Description of Artificial Sequence: Synthetic polypeptide
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 139 - protein, 248 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 140 - protein, 248 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 141 - protein, 239 aa, Artificial Sequence
  Description of Artificial Sequence: Synthetic polypeptide
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 142 - protein, 246 aa, Artificial Sequence
  Description of Artificial Sequence: Synthetic polypeptide
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 143 - protein, 241 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 144 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 145 - protein, 248 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 146 - protein, 244 aa, Artificial Sequence
  Description of Artificial Sequence: Synthetic polypeptide
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 147 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 148 - protein, 251 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 149 - protein, 246 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 150 - DNA, 729 bp, Artificial Sequence
  Description of Artificial Sequence: Synthetic polynucleotide
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 151 - DNA, 735 bp, Artificial Sequence
  Description of Artificial Sequence: Synthetic polynucleotide
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 152 - DNA, 738 bp, Artificial Sequence
  Description of Artificial Sequence: Synthetic polynucleotide
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 153 - DNA, 720 bp, Artificial Sequence
  Description of Artificial Sequence: Synthetic polynucleotide
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 154 - DNA, 723 bp, Artificial Sequence
  Description of Artificial Sequence: Synthetic polynucleotide
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 155 - DNA, 735 bp, Artificial Sequence
  Description of Artificial Sequence: Synthetic polynucleotide
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 156 - DNA, 759 bp, Artificial Sequence
  Description of Artificial Sequence: Synthetic polynucleotide
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 157 - DNA, 744 bp, Artificial Sequence
  Description of Artificial Sequence: Synthetic polynucleotide
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 158 - DNA, 738 bp, Artificial Sequence
  Description of Artificial Sequence: Synthetic polynucleotide
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 159 - DNA, 723 bp, Artificial Sequence
  Description of Artificial Sequence: Synthetic polynucleotide
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 160 - DNA, 744 bp, Artificial Sequence
  Description of Artificial Sequence: Synthetic polynucleotide
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 161 - DNA, 744 bp, Artificial Sequence
  Description of Artificial Sequence: Synthetic polynucleotide
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 162 - DNA, 717 bp, Artificial Sequence
  Description of Artificial Sequence: Synthetic polynucleotide
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 163 - DNA, 738 bp, Artificial Sequence
  Description of Artificial Sequence: Synthetic polynucleotide
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 164 - DNA, 723 bp, Artificial Sequence
  Description of Artificial Sequence: Synthetic polynucleotide
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 165 - DNA, 726 bp, Artificial Sequence
  Description of Artificial Sequence: Synthetic polynucleotide
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 166 - DNA, 744 bp, Artificial Sequence
  Description of Artificial Sequence: Synthetic polynucleotide
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 167 - DNA, 732 bp, Artificial Sequence
  Description of Artificial Sequence: Synthetic polynucleotide
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 168 - DNA, 733 bp, Artificial Sequence
  Description of Artificial Sequence: Synthetic polynucleotide
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 169 - DNA, 753 bp, Artificial Sequence
  Description of Artificial Sequence: Synthetic polynucleotide
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 170 - DNA, 739 bp, Artificial Sequence
  Description of Artificial Sequence: Synthetic polynucleotide
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 171 - protein, 121 aa, Artificial Sequence
  Description of Artificial Sequence: Synthetic polypeptide
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 172 - protein, 123 aa, Artificial Sequence
  Description of Artificial Sequence: Synthetic polypeptide
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 173 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 174 - protein, 117 aa, Artificial Sequence
  Description of Artificial Sequence: Synthetic polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 175 - protein, 120 aa, Artificial Sequence
  Description of Artificial Sequence: Synthetic polypeptide
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 176 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 177 - protein, 129 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 178 - protein, 125 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 179 - protein, 118 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 180 - protein, 118 aa, Artificial Sequence
  Description of Artificial Sequence: Synthetic polypeptide
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 181 - protein, 124 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 182 - protein, 124 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 183 - protein, 117 aa, Artificial Sequence
  Description of Artificial Sequence: Synthetic polypeptide
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 184 - protein, 122 aa, Artificial Sequence
  Description of Artificial Sequence: Synthetic polypeptide
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 185 - protein, 117 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 186 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 187 - protein, 124 aa, Artificial Sequence
  Description of Artificial Sequence: Synthetic polypeptide
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 188 - protein, 120 aa, Artificial Sequence
  Description of Artificial Sequence: Synthetic polypeptide
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 189 - protein, 117 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 190 - protein, 126 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 191 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 192 - protein, 107 aa, Artificial Sequence
  Description of Artificial Sequence: Synthetic polypeptide
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 193 - protein, 107 aa, Artificial Sequence
  Description of Artificial Sequence: Synthetic polypeptide
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 194 - protein, 112 aa, Artificial Sequence
  Description of Artificial Sequence: Synthetic polypeptide
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 195 - protein, 108 aa, Artificial Sequence
  Description of Artificial Sequence: Synthetic polypeptide
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 196 - protein, 106 aa, Artificial Sequence
  Description of Artificial Sequence: Synthetic polypeptide
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 197 - protein, 107 aa, Artificial Sequence
  Description of Artificial Sequence: Synthetic polypeptide
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 198 - protein, 109 aa, Artificial Sequence
  Description of Artificial Sequence: Synthetic polypeptide
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 199 - protein, 108 aa, Artificial Sequence
  Description of Artificial Sequence: Synthetic polypeptide
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 200 - protein, 113 aa, Artificial Sequence
  Description of Artificial Sequence: Synthetic polypeptide
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 201 - protein, 108 aa, Artificial Sequence
  Description of Artificial Sequence: Synthetic polypeptide
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 202 - protein, 109 aa, Artificial Sequence
  Description of Artificial Sequence: Synthetic polypeptide
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 203 - protein, 109 aa, Artificial Sequence
  Description of Artificial Sequence: Synthetic polypeptide
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 204 - protein, 107 aa, Artificial Sequence
  Description of Artificial Sequence: Synthetic polypeptide
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 205 - protein, 109 aa, Artificial Sequence
  Description of Artificial Sequence: Synthetic polypeptide
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 206 - protein, 109 aa, Artificial Sequence
  Description of Artificial Sequence: Synthetic polypeptide
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 207 - protein, 109 aa, Artificial Sequence
  Description of Artificial Sequence: Synthetic polypeptide
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 208 - protein, 109 aa, Artificial Sequence
  Description of Artificial Sequence: Synthetic polypeptide
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 209 - protein, 109 aa, Artificial Sequence
  Description of Artificial Sequence: Synthetic polypeptide
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 210 - protein, 112 aa, Artificial Sequence
  Description of Artificial Sequence: Synthetic polypeptide
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 211 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 212 - protein, 109 aa, Artificial Sequence
  Description of Artificial Sequence: Synthetic polypeptide
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 213 - protein, 487 aa, Artificial Sequence
  Description of Artificial Sequence: Synthetic polypeptide
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 214 - protein, 489 aa, Artificial Sequence
  Description of Artificial Sequence: Synthetic polypeptide
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 215 - protein, 490 aa, Artificial Sequence
  Description of Artificial Sequence: Synthetic polypeptide
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - protein, 484 aa, Artificial Sequence
  Description of Artificial Sequence: Synthetic polypeptide
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - protein, 485 aa, Artificial Sequence
  Description of Artificial Sequence: Synthetic polypeptide
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 218 - protein, 489 aa, Artificial Sequence
  Description of Artificial Sequence: Synthetic polypeptide
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 219 - protein, 497 aa, Artificial Sequence
  Description of Artificial Sequence: Synthetic polypeptide
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - protein, 492 aa, Artificial Sequence
  Description of Artificial Sequence: Synthetic polypeptide
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - protein, 490 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 222 - protein, 485 aa, Artificial Sequence
  Description of Artificial Sequence: Synthetic polypeptide
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 223 - protein, 492 aa, Artificial Sequence
  Description of Artificial Sequence: Synthetic polypeptide
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 224 - protein, 492 aa, Artificial Sequence
  Description of Artificial Sequence: Synthetic polypeptide
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 225 - protein, 483 aa, Artificial Sequence
  Description of Artificial Sequence: Synthetic polypeptide
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 226 - protein, 490 aa, Artificial Sequence
  Description of Artificial Sequence: Synthetic polypeptide
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - protein, 485 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 228 - protein, 486 aa, Artificial Sequence
  Description of Artificial Sequence: Synthetic polypeptide
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 229 - protein, 492 aa, Artificial Sequence
  Description of Artificial Sequence: Synthetic polypeptide
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - protein, 488 aa, Artificial Sequence
  Description of Artificial Sequence: Synthetic polypeptide
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 231 - protein, 488 aa, Artificial Sequence
  Description of Artificial Sequence: Synthetic polypeptide
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 232 - protein, 495 aa, Artificial Sequence
  Description of Artificial Sequence: Synthetic polypeptide
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 233 - protein, 490 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 234 - DNA, 1461 bp, Artificial Sequence
  Description of Artificial Sequence: Synthetic polynucleotide
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 235 - DNA, 1467 bp, Artificial Sequence
  Description of Artificial Sequence: Synthetic polynucleotide
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 236 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 237 - DNA, 1452 bp, Artificial Sequence
  Description of Artificial Sequence: Synthetic polynucleotide
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 238 - DNA, 1455 bp, Artificial Sequence
  Description of Artificial Sequence: Synthetic polynucleotide
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 239 - DNA, 1467 bp, Artificial Sequence
  Description of Artificial Sequence: Synthetic polynucleotide
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 240 - DNA, 1491 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 241 - DNA, 1476 bp, Artificial Sequence
  Description of Artificial Sequence: Synthetic polynucleotide
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 242 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 243 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 244 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 245 - DNA, 1476 bp, Artificial Sequence
  Description of Artificial Sequence: Synthetic polynucleotide
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 246 - DNA, 1449 bp, Artificial Sequence
  Description of Artificial Sequence: Synthetic polynucleotide
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 247 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 248 - DNA, 1455 bp, Artificial Sequence
  Description of Artificial Sequence: Synthetic polynucleotide
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 249 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 250 - DNA, 1476 bp, Artificial Sequence
  Description of Artificial Sequence: Synthetic polynucleotide
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 251 - DNA, 1464 bp, Artificial Sequence
  Description of Artificial Sequence: Synthetic polynucleotide
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 252 - DNA, 1464 bp, Artificial Sequence
  Description of Artificial Sequence: Synthetic polynucleotide
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 253 - DNA, 1485 bp, Artificial Sequence
  Description of Artificial Sequence: Synthetic polynucleotide
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 254 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 255 - protein, 122 aa, Artificial Sequence
  Description of Artificial Sequence: Synthetic polypeptide
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 256 - protein, 117 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 257 - protein, 117 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 258 - protein, 117 aa, Artificial Sequence
  Description of Artificial Sequence: Synthetic polypeptide
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 259 - protein, 107 aa, Artificial Sequence
  Description of Artificial Sequence: Synthetic polypeptide
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 260 - protein, 111 aa, Artificial Sequence
  Description of Artificial Sequence: Synthetic polypeptide
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 261 - protein, 111 aa, Artificial Sequence
  Description of Artificial Sequence: Synthetic polypeptide
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 262 - protein, 111 aa, Artificial Sequence; identical to SEQ ID NO: 261
  Description of Artificial Sequence: Synthetic polypeptide

SEQ ID NO: 263 - protein, 244 aa, Artificial Sequence
  Description of Artificial Sequence: Synthetic polypeptide
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 264 - protein, 249 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 265 - protein, 243 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 266 - protein, 243 aa, Artificial Sequence
  Description of Artificial Sequence: Synthetic polypeptide
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 267 - protein, 467 aa, Artificial Sequence
  Description of Artificial Sequence: Synthetic polypeptide
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 268 - protein, 472 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 269 - protein, 466 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 270 - protein, 466 aa, Artificial Sequence
  Description of Artificial Sequence: Synthetic polypeptide
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 249 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSSGGGGSGGGGSGGGGSGGGGSDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 272 - DNA, 747 bp, Artificial Sequence
  Description of Artificial Sequence: Synthetic polynucleotide
caggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacaacggctacgacgtgctggacaactggggccagggcacactagtgaccgtgtccagcggtggaggaggtagcggaggaggcgggagcggtggaggtggctctggaggtggcggaagcgacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgt

SEQ ID NO: 273 - protein, 249 aa, Artificial Sequence
  Description of Artificial Sequence: Synthetic polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSS

SEQ ID NO: 274 - DNA, 747 bp, Artificial Sequence
  Description of Artificial Sequence: Synthetic polynucleotide
gacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggtggaggaggtagcggaggaggcgggagcggtggaggtggctctggaggtggcggaagccaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacaacggctacgacgtgctggacaactggggccagggcacactagtgaccgtgtccagc

SEQ ID NO: 275 - protein, 132 aa, Artificial Sequence
  Description of Artificial Sequence: Synthetic polypeptide
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 276 - protein, 108 aa, Artificial Sequence
  Description of Artificial Sequence: Synthetic polypeptide
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 277 - protein, 93 aa, Artificial Sequence [sequence omitted]

SEQ ID NO: 278 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 279 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 280 - protein, 95 aa, Artificial Sequence
  Description of Artificial Sequence: Synthetic polypeptide
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 281 - protein, 95 aa, Artificial Sequence
  Description of Artificial Sequence: Synthetic polypeptide
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 282 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 283 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 284 - protein, 1132 aa, Artificial Sequence [sequence omitted]

SEQ ID NO: 285 - DNA, 4027 bp, Artificial Sequence
  Description of Artificial Sequence: Synthetic polynucleotide
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 286 - DNA, 19 bp, Artificial Sequence
  Description of Artificial Sequence: Synthetic oligonucleotide
ggaggtccctcaccttcta

SEQ ID NO: 287 - DNA, 19 bp, Artificial Sequence
  Description of Artificial Sequence: Synthetic oligonucleotide
cggaggatcttatgctgaa

SEQ ID NO: 288 - DNA, 19 bp, Artificial Sequence
  Description of Artificial Sequence: Synthetic oligonucleotide
cccgcttccagatcataca

SEQ ID NO: 289 - DNA, 19 bp, Artificial Sequence
  Description of Artificial Sequence: Synthetic oligonucleotide
ggagacctcaacaagatat

SEQ ID NO: 290 - DNA, 19 bp, Artificial Sequence
  Description of Artificial Sequence: Synthetic oligonucleotide
aaggcatggtcattggtat

SEQ ID NO: 291 - DNA, 19 bp, Artificial Sequence
  Description of Artificial Sequence: Synthetic oligonucleotide
gcatggtcattggtatcat

SEQ ID NO: 292 - DNA, 19 bp, Artificial Sequence
  Description of Artificial Sequence: Synthetic oligonucleotide
ggtcattggtatcatgagt

SEQ ID NO: 293 - DNA, 19 bp, Artificial Sequence
  Description of Artificial Sequence: Synthetic oligonucleotide
cctagtgggtatccctgta

SEQ ID NO: 294 - DNA, 19 bp, Artificial Sequence
  Description of Artificial Sequence: Synthetic oligonucleotide
gaggatggacattgttctt

SEQ ID NO: 295 - DNA, 19 bp, Artificial Sequence
  Description of Artificial Sequence: Synthetic oligonucleotide
gcatgcaggctacagttca

SEQ ID NO: 296 - DNA, 19 bp, Artificial Sequence
  Description of Artificial Sequence: Synthetic oligonucleotide
ccagcacatgcactgttga

SEQ ID NO: 297 - DNA, 19 bp, Artificial Sequence
  Description of Artificial Sequence: Synthetic oligonucleotide
cacatgcactgttgagtga

SEQ ID NO: 298 - DNA, 21 bp, Artificial Sequence
  Description of Artificial Sequence: Synthetic oligonucleotide
ctggaggtccctcaccttcta

SEQ ID NO: 299 - DNA, 21 bp, Artificial Sequence
  Description of Artificial Sequence: Synthetic oligonucleotide
gtcggaggatcttatgctgaa

SEQ ID NO: 300 - DNA, 21 bp, Artificial Sequence
  Description of Artificial Sequence: Synthetic oligonucleotide
tgcccgcttccagatcataca

SEQ ID NO: 301 - DNA, 21 bp, Artificial Sequence
  Description of Artificial Sequence: Synthetic oligonucleotide
ctggagacctcaacaagatat

SEQ ID NO: 302 - DNA, 21 bp, Artificial Sequence
  Description of Artificial Sequence: Synthetic oligonucleotide
tcaaggcatggtcattggtat

SEQ ID NO: 303 - DNA, 21 bp, Artificial Sequence
  Description of Artificial Sequence: Synthetic oligonucleotide
aggcatggtcattggtatcat

SEQ ID NO: 304 - DNA, 21 bp, Artificial Sequence
  Description of Artificial Sequence: Synthetic oligonucleotide
atggtcattggtatcatgagt

SEQ ID NO: 305 - DNA, 21 bp, Artificial Sequence
  Description of Artificial Sequence: Synthetic oligonucleotide
gccctagtgggtatccctgta

SEQ ID NO: 306 - DNA, 21 bp, Artificial Sequence
  Description of Artificial Sequence: Synthetic oligonucleotide
atgaggatggacattgttctt

SEQ ID NO: 307 - DNA, 21 bp, Artificial Sequence
  Description of Artificial Sequence: Synthetic oligonucleotide
gagcatgcaggctacagttca

SEQ ID NO: 308 - DNA, 21 bp, Artificial Sequence
  Description of Artificial Sequence: Synthetic oligonucleotide
ttccagcacatgcactgttga

SEQ ID NO: 309 - DNA, 21 bp, Artificial Sequence
  Description of Artificial Sequence: Synthetic oligonucleotide
agcacatgcactgttgagtga

SEQ ID NO: 310 - DNA, 21 bp, Artificial Sequence
  Description of Artificial Sequence: Synthetic oligonucleotide
tagaaggtgagggacctccag

SEQ ID NO: 311 - DNA, 21 bp, Artificial Sequence
  Description of Artificial Sequence: Synthetic oligonucleotide
ttcagcataagatcctccgac

SEQ ID NO: 312 - DNA, 21 bp, Artificial Sequence
  Description of Artificial Sequence: Synthetic oligonucleotide
tgtatgatctggaagcgggca

SEQ ID NO: 313 - DNA, 21 bp, Artificial Sequence
  Description of Artificial Sequence: Synthetic oligonucleotide
atatcttgttgaggtctccag

SEQ ID NO: 314 - DNA, 21 bp, Artificial Sequence
  Description of Artificial Sequence: Synthetic oligonucleotide
ataccaatgaccatgccttga

SEQ ID NO: 315 - DNA, 21 bp, Artificial Sequence
  Description of Artificial Sequence: Synthetic oligonucleotide
atgataccaatgaccatgcct

SEQ ID NO: 316 - DNA, 21 bp, Artificial Sequence
  Description of Artificial Sequence: Synthetic oligonucleotide
atggtcattggtatcatgagt

SEQ ID NO: 317 - DNA, 21 bp, Artificial Sequence
  Description of Artificial Sequence: Synthetic oligonucleotide
gccctagtgggtatccctgta

SEQ ID NO: 318 - DNA, 21 bp, Artificial Sequence
  Description of Artificial Sequence: Synthetic oligonucleotide
atgaggatggacattgttctt

SEQ ID NO: 319 - DNA, 21 bp, Artificial Sequence
  Description of Artificial Sequence: Synthetic oligonucleotide
gagcatgcaggctacagttca

SEQ ID NO: 320 - DNA, 21 bp, Artificial Sequence
  Description of Artificial Sequence: Synthetic oligonucleotide
ttccagcacatgcactgttga

SEQ ID NO: 321 - DNA, 21 bp, Artificial Sequence
  Description of Artificial Sequence: Synthetic oligonucleotide
agcacatgcactgttgagtga

SEQ ID NO: 322 - DNA, 19 bp, Artificial Sequence
  Description of Artificial Sequence: Synthetic oligonucleotide
tagaaggtgagggacctcc

SEQ ID NO: 323 - DNA, 19 bp, Artificial Sequence
  Description of Artificial Sequence: Synthetic oligonucleotide
ttcagcataagatcctccg

SEQ ID NO: 324 - DNA, 19 bp, Artificial Sequence
  Description of Artificial Sequence: Synthetic oligonucleotide
tgtatgatctggaagcggg

SEQ ID NO: 325 - DNA, 19 bp, Artificial Sequence
  Description of Artificial Sequence: Synthetic oligonucleotide
atatcttgttgaggtctcc

SEQ ID NO: 326 - DNA, 19 bp, Artificial Sequence
  Description of Artificial Sequence: Synthetic oligonucleotide
ataccaatgaccatgcctt

SEQ ID NO: 327 - DNA, 19 bp, Artificial Sequence
  Description of Artificial Sequence: Synthetic oligonucleotide
atgataccaatgaccatgc

SEQ ID NO: 328 - DNA, 19 bp, Artificial Sequence
  Description of Artificial Sequence: Synthetic oligonucleotide
atggtcattggtatcatga

SEQ ID NO: 329 - DNA, 19 bp, Artificial Sequence
  Description of Artificial Sequence: Synthetic oligonucleotide
gccctagtgggtatccctg

SEQ ID NO: 330 - DNA, 19 bp, Artificial Sequence
  Description of Artificial Sequence: Synthetic oligonucleotide
atgaggatggacattgttc

SEQ ID NO: 331 - DNA, 19 bp, Artificial Sequence
  Description of Artificial Sequence: Synthetic oligonucleotide
gagcatgcaggctacagtt

SEQ ID NO: 332 - DNA, 19 bp, Artificial Sequence
  Description of Artificial Sequence: Synthetic oligonucleotide
ttccagcacatgcactgtt

SEQ ID NO: 333 - DNA, 19 bp, Artificial Sequence
  Description of Artificial Sequence: Synthetic oligonucleotide
agcacatgcactgttgagt

SEQ ID NO: 334 - DNA, 19 bp, Artificial Sequence
  Description of Artificial Sequence: Synthetic oligonucleotide
ggccaggatggttcttaga

SEQ ID NO: 335 - DNA, 19 bp, Artificial Sequence
  Description of Artificial Sequence: Synthetic oligonucleotide
gcttcgtgctaaactggta

SEQ ID NO: 336 - DNA, 19 bp, Artificial Sequence
  Description of Artificial Sequence: Synthetic oligonucleotide
gggcgtgacttccacatga

SEQ ID NO: 337 - DNA, 19 bp, Artificial Sequence
  Description of Artificial Sequence: Synthetic oligonucleotide
caggcctagagaagtttca

SEQ ID NO: 338 - DNA, 19 bp, Artificial Sequence
  Description of Artificial Sequence: Synthetic oligonucleotide
cttggaacccattcctgaa

SEQ ID NO: 339 - DNA, 19 bp, Artificial Sequence
  Description of Artificial Sequence: Synthetic oligonucleotide
ggaacccattcctgaaatt

SEQ ID NO: 340 - DNA, 19 bp, Artificial Sequence
  Description of Artificial Sequence: Synthetic oligonucleotide
gaacccattcctgaaatta

SEQ ID NO: 341 - DNA, 19 bp, Artificial Sequence
  Description of Artificial Sequence: Synthetic oligonucleotide
aacccattcctgaaattat

SEQ ID NO: 342 - DNA, 19 bp, Artificial Sequence
  Description of Artificial Sequence: Synthetic oligonucleotide
acccattcctgaaattatt

SEQ ID NO: 343 - DNA, 19 bp, Artificial Sequence
  Description of Artificial Sequence: Synthetic oligonucleotide
cccattcctgaaattattt

SEQ ID NO: 344 - DNA, 19 bp, Artificial Sequence
  Description of Artificial Sequence: Synthetic oligonucleotide
ctgtggttctattatatta

SEQ ID NO: 345 - DNA, 19 bp, Artificial Sequence
  Description of Artificial Sequence: Synthetic oligonucleotide
aaatatgagagcatgctaa

SEQ ID NO: 346 - DNA, 19 bp, Artificial Sequence
  Description of Artificial Sequence: Synthetic oligonucleotide
tctaagaaccatcctggcc

SEQ ID NO: 347 - DNA, 19 bp, Artificial Sequence
  Description of Artificial Sequence: Synthetic oligonucleotide
taccagtttagcacgaagc

SEQ ID NO: 348 - DNA, 19 bp, Artificial Sequence
  Description of Artificial Sequence: Synthetic oligonucleotide
tcatgtggaagtcacgccc

SEQ ID NO: 349 - DNA, 19 bp, Artificial Sequence
  Description of Artificial Sequence: Synthetic oligonucleotide
tgaaacttctctaggcctg

SEQ ID NO: 350 - DNA, 19 bp, Artificial Sequence
  Description of Artificial Sequence: Synthetic oligonucleotide
ttcaggaatgggttccaag

SEQ ID NO: 351 - DNA, 19 bp, Artificial Sequence
  Description of Artificial Sequence: Synthetic oligonucleotide
aatttcaggaatgggttcc

SEQ ID NO: 352 - DNA, 19 bp, Artificial Sequence
  Description of Artificial Sequence: Synthetic oligonucleotide
taatttcaggaatgggttc

SEQ ID NO: 353 - DNA, 19 bp, Artificial Sequence
  Description of Artificial Sequence: Synthetic oligonucleotide
ataatttcaggaatgggtt

SEQ ID NO: 354 - DNA, 19 bp, Artificial Sequence
  Description of Artificial Sequence: Synthetic oligonucleotide
aataatttcaggaatgggt

SEQ ID NO: 355 - DNA, 19 bp, Artificial Sequence
  Description of Artificial Sequence: Synthetic oligonucleotide
aaataatttcaggaatggg

SEQ ID NO: 356 - DNA, 19 bp, Artificial Sequence
  Description of Artificial Sequence: Synthetic oligonucleotide
taatataatagaaccacag

SEQ ID NO: 357 - DNA, 19 bp, Artificial Sequence
  Description of Artificial Sequence: Synthetic oligonucleotide
ttagcatgctctcatattt

SEQ ID NO: 358 - DNA, 21 bp, Artificial Sequence
  Description of Artificial Sequence: Synthetic oligonucleotide
gcggccaggatggttcttaga

SEQ ID NO: 359 - DNA, 21 bp, Artificial Sequence
  Description of Artificial Sequence: Synthetic oligonucleotide
gagcttcgtgctaaactggta

SEQ ID NO: 360 - DNA, 21 bp, Artificial Sequence
  Description of Artificial Sequence: Synthetic oligonucleotide
acgggcgtgacttccacatga

SEQ ID NO: 361 - DNA, 21 bp, Artificial Sequence
  Description of Artificial Sequence: Synthetic oligonucleotide
tgcaggcctagagaagtttca

SEQ ID NO: 362 - DNA, 21 bp, Artificial Sequence
  Description of Artificial Sequence: Synthetic oligonucleotide
tccttggaacccattcctgaa

SEQ ID NO: 363 - DNA, 21 bp, Artificial Sequence
  Description of Artificial Sequence: Synthetic oligonucleotide
ttggaacccattcctgaaatt

SEQ ID NO: 364 - DNA, 21 bp, Artificial Sequence
  Description of Artificial Sequence: Synthetic oligonucleotide
tggaacccattcctgaaatta

SEQ ID NO: 365 - DNA, 21 bp, Artificial Sequence
  Description of Artificial Sequence: Synthetic oligonucleotide
ggaacccattcctgaaattat

SEQ ID NO: 366 - DNA, 21 bp, Artificial Sequence
  Description of Artificial Sequence: Synthetic oligonucleotide
gaacccattcctgaaattatt

SEQ ID NO: 367 - DNA, 21 bp, Artificial Sequence
  Description of Artificial Sequence: Synthetic oligonucleotide
aacccattcctgaaattattt

SEQ ID NO: 368 - DNA, 21 bp, Artificial Sequence
  Description of Artificial Sequence: Synthetic oligonucleotide
ccctgtggttctattatatta

SEQ ID NO: 369 - DNA, 21 bp, Artificial Sequence
  Description of Artificial Sequence: Synthetic oligonucleotide
ttaaatatgagagcatgctaa

SEQ ID NO: 370 - DNA, 21 bp, Artificial Sequence
  Description of Artificial Sequence: Synthetic oligonucleotide
tctaagaaccatcctggccgc

SEQ ID NO: 371 - DNA, 21 bp, Artificial Sequence
  Description of Artificial Sequence: Synthetic oligonucleotide
taccagtttagcacgaagctc

SEQ ID NO: 372 - DNA, 21 bp, Artificial Sequence
  Description of Artificial Sequence: Synthetic oligonucleotide
tcatgtggaagtcacgcccgt

SEQ ID NO: 373 - DNA, 21 bp, Artificial Sequence
  Description of Artificial Sequence: Synthetic oligonucleotide
tgaaacttctctaggcctgca

SEQ ID NO: 374 - DNA, 21 bp, Artificial Sequence
  Description of Artificial Sequence: Synthetic oligonucleotide
ttcaggaatgggttccaagga

SEQ ID NO: 375 - DNA, 21 bp, Artificial Sequence
  Description of Artificial Sequence: Synthetic oligonucleotide
aatttcaggaatgggttccaa

SEQ ID NO: 376 - DNA, 21 bp, Artificial Sequence
  Description of Artificial Sequence: Synthetic oligonucleotide
taatttcaggaatgggttcca

SEQ ID NO: 377 - DNA, 21 bp, Artificial Sequence
  Description of Artificial Sequence: Synthetic oligonucleotide
ataatttcaggaatgggttcc

SEQ ID NO: 378 - DNA, 21 bp, Artificial Sequence
  Description of Artificial Sequence: Synthetic oligonucleotide
aataatttcaggaatgggttc

SEQ ID NO: 379 - DNA, 21 bp, Artificial Sequence
  Description of Artificial Sequence: Synthetic oligonucleotide
aaataatttcaggaatgggtt

SEQ ID NO: 380 - DNA, 21 bp, Artificial Sequence
  Description of Artificial Sequence: Synthetic oligonucleotide
taatataatagaaccacaggg

SEQ ID NO: 381 - DNA, 21 bp, Artificial Sequence
  Description of Artificial Sequence: Synthetic oligonucleotide
ttagcatgctctcatatttaa

SEQ ID NO: 382 - DNA, 150 bp, Artificial Sequence
  Description of Artificial Sequence: Synthetic polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 383 - protein, 4 aa, Artificial Sequence
  Description of Artificial Sequence: Synthetic peptide
RGDS

SEQ ID NO: 384 - protein, 5 aa, Artificial Sequence
  Description of Artificial Sequence: Synthetic peptide
NYAMS

SEQ ID NO: 385 - protein, 5 aa, Artificial Sequence
  Description of Artificial Sequence: Synthetic peptide
DYAMH

SEQ ID NO: 386 - protein, 5 aa, Artificial Sequence
  Description of Artificial Sequence: Synthetic peptide
NHGMS

SEQ ID NO: 387 - protein, 5 aa, Artificial Sequence
  Description of Artificial Sequence: Synthetic peptide
NFGIN

SEQ ID NO: 388 - protein, 5 aa, Artificial Sequence
  Description of Artificial Sequence: Synthetic peptide
SDAMT

SEQ ID NO: 389 - protein, 5 aa, Artificial Sequence
  Description of Artificial Sequence: Synthetic peptide
NYGIT

SEQ ID NO: 390 - protein, 5 aa, Artificial Sequence
  Description of Artificial Sequence: Synthetic peptide
NHGMS

SEQ ID NO: 391 - protein, 5 aa, Artificial Sequence
  Description of Artificial Sequence: Synthetic peptide
NHGMS

SEQ ID NO: 392 - protein, 5 aa, Artificial Sequence
  Description of Artificial Sequence: Synthetic peptide
NHGMS

SEQ ID NO: 393 - protein, 5 aa, Artificial Sequence
  Description of Artificial Sequence: Synthetic peptide
DYYMS

SEQ ID NO: 394 - protein, 5 aa, Artificial Sequence
  Description of Artificial Sequence: Synthetic peptide
NHGMS

SEQ ID NO: 395 - protein, 5 aa, Artificial Sequence
  Description of Artificial Sequence: Synthetic peptide
DYYMS

SEQ ID NO: 396 - protein, 5 aa, Artificial Sequence
  Description of Artificial Sequence: Synthetic peptide
NHGMS

SEQ ID NO: 397 - protein, 5 aa, Artificial Sequence
  Description of Artificial Sequence: Synthetic peptide
NHGMS

SEQ ID NO: 398 - protein, 5 aa, Artificial Sequence
  Description of Artificial Sequence: Synthetic peptide
NHGMS

SEQ ID NO: 399 - protein, 7 aa, Artificial Sequence
  Description of Artificial Sequence: Synthetic peptide
SSYYYWG

SEQ ID NO: 400 - protein, 7 aa, Artificial Sequence
  Description of Artificial Sequence: Synthetic peptide
TSGMCVS

SEQ ID NO: 401 - protein, 5 aa, Artificial Sequence
  Description of Artificial Sequence: Synthetic peptide
SYSMN

SEQ ID NO: 402 - protein, 5 aa, Artificial Sequence
  Description of Artificial Sequence: Synthetic peptide
DYYMS

SEQ ID NO: 403 - protein, 5 aa, Artificial Sequence
  Description of Artificial Sequence: Synthetic peptide
SHYIH

SEQ ID NO: 404 - protein, 7 aa, Artificial Sequence
  Description of Artificial Sequence: Synthetic peptide
SGGYYWS

SEQ ID NO: 405 - protein, 5 aa, Artificial Sequence
  Description of Artificial Sequence: Synthetic peptide
SYAIS

SEQ ID NO: 406 - protein, 7 aa, Artificial Sequence
  Description of Artificial Sequence: Synthetic peptide
SNSAAWN

SEQ ID NO: 407 - protein, 5 aa, Artificial Sequence
  Description of Artificial Sequence: Synthetic peptide
SYAMS

SEQ ID NO: 408 - protein, 5 aa, Artificial Sequence
  Description of Artificial Sequence: Synthetic peptide
RYPMS

SEQ ID NO: 409 - protein, 5 aa, Artificial Sequence
  Description of Artificial Sequence: Synthetic peptide
SYAMS

SEQ ID NO: 410 - protein, 5 aa, Artificial Sequence
  Description of Artificial Sequence: Synthetic peptide
SYAMS

SEQ ID NO: 411 - protein, 5 aa, Artificial Sequence
  Description of Artificial Sequence: Synthetic peptide
DYAMH

SEQ ID NO: 412 - protein, 5 aa, Artificial Sequence
  Description of Artificial Sequence: Synthetic peptide
DYAMH

SEQ ID NO: 413 - protein, 5 aa, Artificial Sequence
  Description of Artificial Sequence: Synthetic peptide
SYAMS

SEQ ID NO: 414 - protein, 5 aa, Artificial Sequence
  Description of Artificial Sequence: Synthetic peptide
SYAMS

SEQ ID NO: 415 - protein, 5 aa, Artificial Sequence
  Description of Artificial Sequence: Synthetic peptide
SYAMS

SEQ ID NO: 416 - protein, 5 aa, Artificial Sequence
  Description of Artificial Sequence: Synthetic peptide
SYAMS

SEQ ID NO: 417 - protein, 5 aa, Artificial Sequence
  Description of Artificial Sequence: Synthetic peptide
SYAMS

SEQ ID NO: 418 - protein, 5 aa, Artificial Sequence
  Description of Artificial Sequence: Synthetic peptide
SYAMS

SEQ ID NO: 419 - protein, 5 aa, Artificial Sequence
  Description of Artificial Sequence: Synthetic peptide
SYAMS

SEQ ID NO: 420 - protein, 5 aa, Artificial Sequence
  Description of Artificial Sequence: Synthetic peptide
NFGMN

SEQ ID NO: 421 - protein, 5 aa, Artificial Sequence
  Description of Artificial Sequence: Synthetic peptide
DYSIN

SEQ ID NO: 422 - protein, 5 aa, Artificial Sequence
  Description of Artificial Sequence: Synthetic peptide
HYSMN

SEQ ID NO: 423 - protein, 5 aa, Artificial Sequence
  Description of Artificial Sequence: Synthetic peptide
HYSMN

SEQ ID NO: 424 - protein, 17 aa, Artificial Sequence
  Description of Artificial Sequence: Synthetic peptide
GISRSGENTYYADSVKG

SEQ ID NO: 425 - protein, 17 aa, Artificial Sequence
  Description of Artificial Sequence: Synthetic peptide
GISWNSGSIGYADSVKG

SEQ ID NO: 426 - protein, 16 aa, Artificial Sequence
  Description of Artificial Sequence: Synthetic peptide
GIVYSGSTYYAASVKG

SEQ ID NO: 427 - protein, 17 aa, Artificial Sequence
  Description of Artificial Sequence: Synthetic peptide
WINPKNNNTNYAQKFQG

SEQ ID NO: 428 - protein, 17 aa, Artificial Sequence
  Description of Artificial Sequence: Synthetic peptide
VISGSGGTTYYADSVKG

SEQ ID NO: 429 - protein, 17 aa, Artificial Sequence
  Description of Artificial Sequence: Synthetic peptide
WISAYNGNTNYAQKFQG

SEQ ID NO: 430 - protein, 16 aa, Artificial Sequence
  Description of Artificial Sequence: Synthetic peptide
GIVYSGSTYYAASVKG

SEQ ID NO: 431 - protein, 16 aa, Artificial Sequence
  Description of Artificial Sequence: Synthetic peptide
GIVYSGSTYYAASVKG

SEQ ID NO: 432 - protein, 16 aa, Artificial Sequence
  Description of Artificial Sequence: Synthetic peptide
GIVYSGSTYYAASVKG

SEQ ID NO: 433 - protein, 17 aa, Artificial Sequence
  Description of Artificial Sequence: Synthetic peptide
YISSSGSTIYYADSVKG

SEQ ID NO: 434 - protein, 16 aa, Artificial Sequence
  Description of Artificial Sequence: Synthetic peptide
GIVYSGSTYYAASVKG

SEQ ID NO: 435 - protein, 17 aa, Artificial Sequence
  Description of Artificial Sequence: Synthetic peptide
YISSSGNTIYYADSVKG

SEQ ID NO: 436 - protein, 16 aa, Artificial Sequence
  Description of Artificial Sequence: Synthetic peptide
GIVYSGSTYYAASVKG

SEQ ID NO: 437 - protein, 16 aa, Artificial Sequence
  Description of Artificial Sequence: Synthetic peptide
GIVYSGSTYYAASVKG

SEQ ID NO: 438 - protein, 16 aa, Artificial Sequence
  Description of Artificial Sequence: Synthetic peptide
GIVYSGSTYYAASVKG

SEQ ID NO: 439 - protein, 16 aa, Artificial Sequence
  Description of Artificial Sequence: Synthetic peptide
SIYYSGSAYYNPSLKS

SEQ ID NO: 440 - protein, 16 aa, Artificial Sequence
  Description of Artificial Sequence: Synthetic peptide
RIDWDEDKFYSTSLKT

SEQ ID NO: 441 - protein, 17 aa, Artificial Sequence
  Description of Artificial Sequence: Synthetic peptide
SISSSSSYIYYADSVKG

SEQ ID NO: 442 - protein, 17 aa, Artificial Sequence
  Description of Artificial Sequence: Synthetic peptide
YISSSGSTIYYADSVKG

SEQ ID NO: 443 - protein, 17 aa, Artificial Sequence
  Description of Artificial Sequence: Synthetic peptide
MINPSGGVTAYSQTLQG

SEQ ID NO: 444 - protein, 16 aa, Artificial Sequence
  Description of Artificial Sequence: Synthetic peptide
YIYYSGSTYYNPSLKS

SEQ ID NO: 445 - protein, 17 aa, Artificial Sequence
  Description of Artificial Sequence: Synthetic peptide
GIIPIFGTANYAQKFQG

SEQ ID NO: 446 - protein, 18 aa, Artificial Sequence
  Description of Artificial Sequence: Synthetic peptide
RTYYRSKWYSFYAISLKS

SEQ ID NO: 447 - protein, 17 aa, Artificial Sequence
  Description of Artificial Sequence: Synthetic peptide
AISGSGGSTYYADSVKG

SEQ ID NO: 448 - protein, 17 aa, Artificial Sequence
  Description of Artificial Sequence: Synthetic peptide
GISDSGVSTYYADSAKG

SEQ ID NO: 449 - protein, 17 aa, Artificial Sequence
  Description of Artificial Sequence: Synthetic peptide
AISGSGGSTYYADSVKG

SEQ ID NO: 450 - protein, 17 aa, Artificial Sequence
  Description of Artificial Sequence: Synthetic peptide
AISGSGGSTYYADSVKG

SEQ ID NO: 451 - protein, 17 aa, Artificial Sequence
  Description of Artificial Sequence: Synthetic peptide
GISWNSGSIGYADSVKG

SEQ ID NO: 452 - protein, 17 aa, Artificial Sequence
  Description of Artificial Sequence: Synthetic peptide
SINWKGNSLAYGDSVKG

SEQ ID NO: 453 - protein, 17 aa, Artificial Sequence
  Description of Artificial Sequence: Synthetic peptide
AISGSGGSTYYADSVKG

SEQ ID NO: 454 - protein, 17 aa, Artificial Sequence
  Description of Artificial Sequence: Synthetic peptide
AISGSGGSTYYADSVKG

SEQ ID NO: 455 - protein, 17 aa, Artificial Sequence
  Description of Artificial Sequence: Synthetic peptide
AISGSGGSTYYADSVKG

SEQ ID NO: 456 - protein, 17 aa, Artificial Sequence
  Description of Artificial Sequence: Synthetic peptide
AISGSGGSTYYADSVKG

SEQ ID NO: 457 - protein, 17 aa, Artificial Sequence
  Description of Artificial Sequence: Synthetic peptide
AISGSGGSTYYADSVKG

SEQ ID NO: 458 - protein, 17 aa, Artificial Sequence
  Description of Artificial Sequence: Synthetic peptide
AISGSGGSTYYADSVKG

SEQ ID NO: 459 - protein, 17 aa, Artificial Sequence
  Description of Artificial Sequence: Synthetic peptide
AISGSGGSTYYADSVKG

SEQ ID NO: 460 - protein, 17 aa, Artificial Sequence
  Description of Artificial Sequence: Synthetic peptide
WINTYTGESYFADDFKG

SEQ ID NO: 461 - protein, 17 aa, Artificial Sequence
  Description of Artificial Sequence: Synthetic peptide
WINTETREPAYAYDFRG

SEQ ID NO: 462 - protein, 17 aa, Artificial Sequence
  Description of Artificial Sequence: Synthetic peptide
RINTESGVPIYADDFKG

SEQ ID NO: 463 - protein, 17 aa, Artificial Sequence
  Description of Artificial Sequence: Synthetic peptide
RINTETGEPLYADDFKG

SEQ ID NO: 464 - protein, 11 aa, Artificial Sequence
  Description of Artificial Sequence: Synthetic peptide
SPAHYYGGMDV

SEQ ID NO: 465 - protein, 6 aa, Artificial Sequence
  Description of Artificial Sequence: Synthetic peptide
HSFLAY

SEQ ID NO: 466 - protein, 7 aa, Artificial Sequence
  Description of Artificial Sequence: Synthetic peptide
HGGESDV

SEQ ID NO: 467 - protein, 11 aa, Artificial Sequence
  Description of Artificial Sequence: Synthetic peptide
GPYYYQSYMDV

SEQ ID NO: 468 - protein, 14 aa, Artificial Sequence
  Description of Artificial Sequence: Synthetic peptide
LDSSGYYYARGPRY

SEQ ID NO: 469 - protein, 9 aa, Artificial Sequence
  Description of Artificial Sequence: Synthetic peptide
GPYYYYMDV

SEQ ID NO: 470 - protein, 7 aa, Artificial Sequence
  Description of Artificial Sequence: Synthetic peptide
HGGESDV

SEQ ID NO: 471 - protein, 7 aa, Artificial Sequence
  Description of Artificial Sequence: Synthetic peptide
HGGESDV

SEQ ID NO: 472 - protein, 7 aa, Artificial Sequence
  Description of Artificial Sequence: Synthetic peptide
HGGESDV

SEQ ID NO: 473 - protein, 8 aa, Artificial Sequence
  Description of Artificial Sequence: Synthetic peptide
ESGDGMDV

SEQ ID NO: 474 - protein, 7 aa, Artificial Sequence
  Description of Artificial Sequence: Synthetic peptide
HGGESDV

SEQ ID NO: 475 - protein, 8 aa, Artificial Sequence
  Description of Artificial Sequence: Synthetic peptide
STMVREDY

SEQ ID NO: 476 - protein, 7 aa, Artificial Sequence
  Description of Artificial Sequence: Synthetic peptide
HGGESDV

SEQ ID NO: 477 - protein, 7 aa, Artificial Sequence
  Description of Artificial Sequence: Synthetic peptide
HGGESDV

SEQ ID NO: 478 - protein, 7 aa, Artificial Sequence
  Description of Artificial Sequence: Synthetic peptide
HGGESDV

SEQ ID NO: 479 - protein, 11 aa, Artificial Sequence
  Description of Artificial Sequence: Synthetic peptide
HWQEWPDAFDI

SEQ ID NO: 480 - protein, 13 aa, Artificial Sequence
  Description of Artificial Sequence: Synthetic peptide
SGAGGTSATAFDI

SEQ ID NO: 481 - protein, 10 aa, Artificial Sequence
  Description of Artificial Sequence: Synthetic peptide
TIAAVYAFDI

SEQ ID NO: 482 - protein, 8 aa, Artificial Sequence
  Description of Artificial Sequence: Synthetic peptide
DLRGAFDI

SEQ ID NO: 483 - protein, 11 aa, Artificial Sequence
  Description of Artificial Sequence: Synthetic peptide
EGSGSGWYFDF

SEQ ID NO: 484 - protein, 13 aa, Artificial Sequence
  Description of Artificial Sequence: Synthetic peptide
AGIAARLRGAFDI

SEQ ID NO: 485 - protein, 20 aa, Artificial Sequence
  Description of Artificial Sequence: Synthetic peptide
RGGYQLLRWDVGLLRSAFDI

SEQ ID NO: 486 - protein, 13 aa, Artificial Sequence
  Description of Artificial Sequence: Synthetic peptide
SSPEGLFLYWFDP

SEQ ID NO: 487 - protein, 9 aa, Artificial Sequence
  Description of Artificial Sequence: Synthetic peptide
VEGSGSLDY

SEQ ID NO: 488 - protein, 9 aa, Artificial Sequence
  Description of Artificial Sequence: Synthetic peptide
RAGSEASDI

SEQ ID NO: 489 - protein, 15 aa, Artificial Sequence
  Description of Artificial Sequence: Synthetic peptide
ATYKRELRYYYGMDV

SEQ ID NO: 490 - protein, 15 aa, Artificial Sequence
  Description of Artificial Sequence: Synthetic peptide
ATYKRELRYYYGMDV

SEQ ID NO: 491 - protein, 8 aa, Artificial Sequence
  Description of Artificial Sequence: Synthetic peptide
VGKAVPDV

SEQ ID NO: 492 - protein, 13 aa, Artificial Sequence
  Description of Artificial Sequence: Synthetic peptide
HQGVAYYNYAMDV

SEQ ID NO: 493 - protein, 8 aa, Artificial Sequence
  Description of Artificial Sequence: Synthetic peptide
VVRDGMDV

SEQ ID NO: 494 - protein, 9 aa, Artificial Sequence
  Description of Artificial Sequence: Synthetic peptide
IPQTGTFDY

SEQ ID NO: 495 - protein, 15 aa, Artificial Sequence
  Description of Artificial Sequence: Synthetic peptide
ANYKRELRYYYGMDV

SEQ ID NO: 496 - protein, 11 aa, Artificial Sequence
  Description of Artificial Sequence: Synthetic peptide
ALVGATGAFDI

SEQ ID NO: 497 - protein, 8 aa, Artificial Sequence
  Description of Artificial Sequence: Synthetic peptide
WFGEGFDP

SEQ ID NO: 498 - protein, 17 aa, Artificial Sequence
  Description of Artificial Sequence: Synthetic peptide
VGYDSSGYYRDYYGMDV

SEQ ID NO: 499 - protein, 13 aa, Artificial Sequence
  Description of Artificial Sequence: Synthetic peptide
MGWSSGYLGAFDI

SEQ ID NO: 500 - protein, 13 aa, Artificial Sequence
  Description of Artificial Sequence: Synthetic peptide
GEIYYGYDGGFAY

SEQ ID NO: 501 - protein, 8 aa, Artificial Sequence
  Description of Artificial Sequence: Synthetic peptide
DYSYAMDY

SEQ ID NO: 502 - protein, 8 aa, Artificial Sequence
  Description of Artificial Sequence: Synthetic peptide
DYLYSLDF

SEQ ID NO: 503 - protein, 8 aa, Artificial Sequence
  Description of Artificial Sequence: Synthetic peptide
DYLYSCDY

SEQ ID NO: 504 - protein, 12 aa, Artificial Sequence
  Description of Artificial Sequence: Synthetic peptide
RASQSISSSFLA

SEQ ID NO: 505 - protein, 16 aa, Artificial Sequence
  Description of Artificial Sequence: Synthetic peptide
RSSQSLLHSNGYNYLD

SEQ ID NO: 506 - protein, 16 aa, Artificial Sequence
  Description of Artificial Sequence: Synthetic peptide
KSSQSLLRNDGKTPLY

SEQ ID NO: 507 - protein, 16 aa, Artificial Sequence
  Description of Artificial Sequence: Synthetic peptide
RSSQSLLHSNGYNYLN

SEQ ID NO: 508 - protein, 11 aa, Artificial Sequence
  Description of Artificial Sequence: Synthetic peptide
RASQSISSYLN

SEQ ID NO: 509 - protein, 16 aa, Artificial Sequence
  Description of Artificial Sequence: Synthetic peptide
RSSQSLLYSNGYNYVD

SEQ ID NO: 510 - protein, 11 aa, Artificial Sequence
  Description of Artificial Sequence: Synthetic peptide
RASQSVSSNLA

SEQ ID NO: 511 - protein, 11 aa, Artificial Sequence
  Description of Artificial Sequence: Synthetic peptide
RASQSVSSKLA

SEQ ID NO: 512 - protein, 12 aa, Artificial Sequence
  Description of Artificial Sequence: Synthetic peptide
RASQSVGSTNLA

SEQ ID NO: 513 - protein, 11 aa, Artificial Sequence
  Description of Artificial Sequence: Synthetic peptide
RASQSISSYLN

SEQ ID NO: 514 - protein, 11 aa, Artificial Sequence
  Description of Artificial Sequence: Synthetic peptide
RASQSISSYLN

SEQ ID NO: 515 - protein, 16 aa, Artificial Sequence
  Description of Artificial Sequence: Synthetic peptide
KSSESLVHNSGKTYLN

SEQ ID NO: 516 - protein, 11 aa, Artificial Sequence
  Description of Artificial Sequence: Synthetic peptide
QASEDINKFLN

SEQ ID NO: 517 - protein, 11 aa, Artificial Sequence
  Description of Artificial Sequence: Synthetic peptide
RASQSVGSNLA

SEQ ID NO: 518 - protein, 12 aa, Artificial Sequence
  Description of Artificial Sequence: Synthetic peptide
RASQSIGSSSLA

SEQ ID NO: 519 - protein, 11 aa, Artificial Sequence
  Description of Artificial Sequence: Synthetic peptide
KASQDIDDAMN

SEQ ID NO: 520 - protein, 11 aa, Artificial Sequence
  Description of Artificial Sequence: Synthetic peptide
RASQDIYNNLA

SEQ ID NO: 521 - protein, 16 aa, Artificial Sequence
  Description of Artificial Sequence: Synthetic peptide
RSSQSLLHSNGYNYLD

SEQ ID NO: 522 - protein, 11 aa, Artificial Sequence
  Description of Artificial Sequence: Synthetic peptide
GGNNIGTKSVH

SEQ ID NO: 523 - protein, 11 aa, Artificial Sequence
  Description of Artificial Sequence: Synthetic peptide
SGDGLSKKYVS

SEQ ID NO: 524 - protein, 11 aa, Artificial Sequence
  Description of Artificial Sequence: Synthetic peptide
RASQGIRNWLA

SEQ ID NO: 525 - protein, 11 aa, Artificial Sequence
  Description of Artificial Sequence: Synthetic peptide
GGNNIGSKSVH

SEQ ID NO: 526 - protein, 11 aa, Artificial Sequence
  Description of Artificial Sequence: Synthetic peptide
QGDSLGNYYAT

SEQ ID NO: 527 - protein, 12 aa, Artificial Sequence
  Description of Artificial Sequence: Synthetic peptide
RASQSVSSAYLA

SEQ ID NO: 528 - protein, 11 aa, Artificial Sequence
  Description of Artificial Sequence: Synthetic peptide
RASQSVSNSLA

SEQ ID NO: 529 - protein, 12 aa, Artificial Sequence
  Description of Artificial Sequence: Synthetic peptide
RASQSVSSSFLA

SEQ ID NO: 530 - protein, 12 aa, Artificial Sequence
  Description of Artificial Sequence: Synthetic peptide
RASQSVSTTFLA

SEQ ID NO: 531 - protein, 11 aa, Artificial Sequence
  Description of Artificial Sequence: Synthetic peptide
RASQSISSYLN

SEQ ID NO: 532 - protein, 12 aa, Artificial Sequence
  Description of Artificial Sequence: Synthetic peptide
RATQSIGSSFLA

SEQ ID NO: 533 - protein, 12 aa, Artificial Sequence
  Description of Artificial Sequence: Synthetic peptide
RASQSVSSSYLA

SEQ ID NO: 534 - protein, 12 aa, Artificial Sequence
  Description of Artificial Sequence: Synthetic peptide
RASQSVSSSYLA

SEQ ID NO: 535 - protein, 12 aa, Artificial Sequence
  Description of Artificial Sequence: Synthetic peptide
RASQRVASNYLA

SEQ ID NO: 536 - protein, 12 aa, Artificial Sequence
  Description of Artificial Sequence: Synthetic peptide
RASQSLSSNFLA

SEQ ID NO: 537 - protein, 16 aa, Artificial Sequence
  Description of Artificial Sequence: Synthetic peptide
RSSQSLLHSNGYNYLD

SEQ ID NO: 538 - protein, 12 aa, Artificial Sequence
  Description of Artificial Sequence: Synthetic peptide
RASQSVSSSYLA

SEQ ID NO: 539 - protein, 12 aa, Artificial Sequence
  Description of Artificial Sequence: Synthetic peptide
RASQSVASSFLA

SEQ ID NO: 540 - protein, 11 aa, Artificial Sequence
  Description of Artificial Sequence: Synthetic peptide
RASQDVNTAVS

SEQ ID NO: 541 - protein, 15 aa, Artificial Sequence
  Description of Artificial Sequence: Synthetic peptide
RASESVSVIGAHLIH

SEQ ID NO: 542 - protein, 15 aa, Artificial Sequence
  Description of Artificial Sequence: Synthetic peptide
RASESVTILGSHLIY

SEQ ID NO: 543 - protein, 15 aa, Artificial Sequence
  Description of Artificial Sequence: Synthetic peptide
RASESVTILGSHLIY

SEQ ID NO: 544 - protein, 7 aa, Artificial Sequence
  Description of Artificial Sequence: Synthetic peptide
GASRRAT

SEQ ID NO: 545 - protein, 7 aa, Artificial Sequence
  Description of Artificial Sequence: Synthetic peptide
LGSNRAS

SEQ ID NO: 546 - protein, 7 aa, Artificial Sequence
  Description of Artificial Sequence: Synthetic peptide
EVSNRFS

SEQ ID NO: 547 - protein, 7 aa, Artificial Sequence
  Description of Artificial Sequence: Synthetic peptide
LGSKRAS

SEQ ID NO: 548 - protein, 7 aa, Artificial Sequence
  Description of Artificial Sequence: Synthetic peptide
GASTLAS

SEQ ID NO: 549 - protein, 7 aa, Artificial Sequence
  Description of Artificial Sequence: Synthetic peptide
LGSNRAS

SEQ ID NO: 550 - protein, 7 aa, Artificial Sequence
  Description of Artificial Sequence: Synthetic peptide
GASTRAS

SEQ ID NO: 551 - protein, 7 aa, Artificial Sequence
  Description of Artificial Sequence: Synthetic peptide
GASIRAT

SEQ ID NO: 552 - protein, 7 aa, Artificial Sequence
  Description of Artificial Sequence: Synthetic peptide
DASNRAT

SEQ ID NO: 553 - protein, 7 aa, Artificial Sequence
  Description of Artificial Sequence: Synthetic peptide
AASSLQS

SEQ ID NO: 554 - protein, 7 aa, Artificial Sequence
  Description of Artificial Sequence: Synthetic peptide
AASSLQS

SEQ ID NO: 555 - protein, 7 aa, Artificial Sequence
  Description of Artificial Sequence: Synthetic peptide
EVSNRDS

SEQ ID NO: 556 - protein, 7 aa, Artificial Sequence
  Description of Artificial Sequence: Synthetic peptide
DASTLQT

SEQ ID NO: 557 - protein, 7 aa, Artificial Sequence
  Description of Artificial Sequence: Synthetic peptide
GASTRAT

SEQ ID NO: 558 - protein, 7 aa, Artificial Sequence
  Description of Artificial Sequence: Synthetic peptide
GASSRAS

SEQ ID NO: 559 - protein, 7 aa, Artificial Sequence
  Description of Artificial Sequence: Synthetic peptide
SATSPVP

SEQ ID NO: 560 - protein, 7 aa, Artificial Sequence
  Description of Artificial Sequence: Synthetic peptide
AANKSQS

SEQ ID NO: 561 - protein, 7 aa, Artificial Sequence
  Description of Artificial Sequence: Synthetic peptide
LGSNRAS

SEQ ID NO: 562 - protein, 7 aa, Artificial Sequence
  Description of Artificial Sequence: Synthetic peptide
DDSVRPS

SEQ ID NO: 563 - protein, 7 aa, Artificial Sequence
  Description of Artificial Sequence: Synthetic peptide
RDKERPS

SEQ ID NO: 564 - protein, 7 aa, Artificial Sequence
  Description of Artificial Sequence: Synthetic peptide
AASNLQS

SEQ ID NO: 565 - protein, 7 aa, Artificial Sequence
  Description of Artificial Sequence: Synthetic peptide
GKNNRPS

SEQ ID NO: 566 - protein, 7 aa, Artificial Sequence
  Description of Artificial Sequence: Synthetic peptide
GTNNRPS

SEQ ID NO: 567 - protein, 7 aa, Artificial Sequence
  Description of Artificial Sequence: Synthetic peptide
GASTRAT

SEQ ID NO: 568 - protein, 7 aa, Artificial Sequence
  Description of Artificial Sequence: Synthetic peptide
DASSRAT

SEQ ID NO: 569 - protein, 7 aa, Artificial Sequence
  Description of Artificial Sequence: Synthetic peptide
GASSRAT

SEQ ID NO: 570 - protein, 7 aa, Artificial Sequence
  Description of Artificial Sequence: Synthetic peptide
GSSNRAT

SEQ ID NO: 571 - protein, 7 aa, Artificial Sequence
  Description of Artificial Sequence: Synthetic peptide
AASSLQS

SEQ ID NO: 572 - protein, 7 aa, Artificial Sequence
  Description of Artificial Sequence: Synthetic peptide
GASQRAT

SEQ ID NO: 573 - protein, 7 aa, Artificial Sequence
  Description of Artificial Sequence: Synthetic peptide
GASSRAT

SEQ ID NO: 574 - protein, 7 aa, Artificial Sequence
  Description of Artificial Sequence: Synthetic peptide
GASSRAT

SEQ ID NO: 575 - protein, 7 aa, Artificial Sequence
  Description of Artificial Sequence: Synthetic peptide
GASSRAT

SEQ ID NO: 576 - protein, 7 aa, Artificial Sequence
  Description of Artificial Sequence: Synthetic peptide
GASNWAT

SEQ ID NO: 577 - protein, 7 aa, Artificial Sequence
  Description of Artificial Sequence: Synthetic peptide
LGSNRAS

SEQ ID NO: 578 - protein, 7 aa, Artificial Sequence
  Description of Artificial Sequence: Synthetic peptide
GTSSRAT

SEQ ID NO: 579 - protein, 7 aa, Artificial Sequence
  Description of Artificial Sequence: Synthetic peptide
GASGRAT

SEQ ID NO: 580 - protein, 7 aa, Artificial Sequence
  Description of Artificial Sequence: Synthetic peptide
SASYRYT

SEQ ID NO: 581 - protein, 7 aa, Artificial Sequence
  Description of Artificial Sequence: Synthetic peptide
LASNLET

SEQ ID NO: 582 - protein, 7 aa, Artificial Sequence
  Description of Artificial Sequence: Synthetic peptide
LASNVQT

SEQ ID NO: 583 - protein, 7 aa, Artificial Sequence
  Description of Artificial Sequence: Synthetic peptide
LASNVQT

SEQ ID NO: 584 - protein, 10 aa, Artificial Sequence
  Description of Artificial Sequence: Synthetic peptide
QQYHSSPSWT

SEQ ID NO: 585 - protein, 9 aa, Artificial Sequence
  Description of Artificial Sequence: Synthetic peptide
MQALQTPYT

SEQ ID NO: 586 - protein, 8 aa, Artificial Sequence
  Description of Artificial Sequence: Synthetic peptide
MQNIQFPS

SEQ ID NO: 587 - protein, 9 aa, Artificial Sequence
  Description of Artificial Sequence: Synthetic peptide
MQALQTPYT

SEQ ID NO: 588 - protein, 8 aa, Artificial Sequence
  Description of Artificial Sequence: Synthetic peptide
QQSYKRAS

SEQ ID NO: 589 - protein, 9 aa, Artificial Sequence
  Description of Artificial Sequence: Synthetic peptide
MQGRQFPYS

SEQ ID NO: 590 - protein, 8 aa, Artificial Sequence
  Description of Artificial Sequence: Synthetic peptide
QQYGSSLT

SEQ ID NO: 591 - protein, 9 aa, Artificial Sequence
  Description of Artificial Sequence: Synthetic peptide
QQYGSSSWT

SEQ ID NO: 592 - protein, 10 aa, Artificial Sequence
  Description of Artificial Sequence: Synthetic peptide
QQYGSSPPWT

SEQ ID NO: 593 - protein, 7 aa, Artificial Sequence
  Description of Artificial Sequence: Synthetic peptide
QQSYTLA

SEQ ID NO: 594 - protein, 9 aa, Artificial Sequence
  Description of Artificial Sequence: Synthetic peptide
QQSYSTPYT

SEQ ID NO: 595 - protein, 9 aa, Artificial Sequence
  Description of Artificial Sequence: Synthetic peptide
MQGTHWPGT

SEQ ID NO: 596 - protein, 9 aa, Artificial Sequence
  Description of Artificial Sequence: Synthetic peptide
QQYESLPLT

SEQ ID NO: 597 - protein, 10 aa, Artificial Sequence
  Description of Artificial Sequence: Synthetic peptide
QQYNDWLPVT

SEQ ID NO: 598 - protein, 10 aa, Artificial Sequence
  Description of Artificial Sequence: Synthetic peptide
QQYAGSPPFT

SEQ ID NO: 599 - protein, 9 aa, Artificial Sequence
  Description of Artificial Sequence: Synthetic peptide
LQHDNFPLT

SEQ ID NO: 600 - protein, 9 aa, Artificial Sequence
  Description of Artificial Sequence: Synthetic peptide
QHYYRFPYS

SEQ ID NO: 601 - protein, 9 aa, Artificial Sequence
  Description of Artificial Sequence: Synthetic peptide
MQALQTPYT

SEQ ID NO: 602 - protein, 11 aa, Artificial Sequence
  Description of Artificial Sequence: Synthetic peptide
QVWDSDSEHVV

SEQ ID NO: 603 - protein, 9 aa, Artificial Sequence
  Description of Artificial Sequence: Synthetic peptide
QAWDDTTVV

SEQ ID NO: 604 - protein, 9 aa, Artificial Sequence
  Description of Artificial Sequence: Synthetic peptide
QKYNSAPFT

SEQ ID NO: 605 - protein, 12 aa, Artificial Sequence
  Description of Artificial Sequence: Synthetic peptide
SSRDSSGDHLRV

SEQ ID NO: 606 - protein, 11 aa, Artificial Sequence
  Description of Artificial Sequence: Synthetic peptide
NSRDSSGHHLL

SEQ ID NO: 607 - protein, 14 aa, Artificial Sequence
  Description of Artificial Sequence: Synthetic peptide
QHYGSSFNGSSLFT

SEQ ID NO: 608 - protein, 10 aa, Artificial Sequence
  Description of Artificial Sequence: Synthetic peptide
QQFGTSSGLT

SEQ ID NO: 609 - protein, 10 aa, Artificial Sequence
  Description of Artificial Sequence: Synthetic peptide
QQYHSSPSWT

SEQ ID NO: 610 - protein, 10 aa, Artificial Sequence
  Description of Artificial Sequence: Synthetic peptide
QQYHSSPSWT

SEQ ID NO: 611 - protein, 9 aa, Artificial Sequence
  Description of Artificial Sequence: Synthetic peptide
QQSYSTPYS

SEQ ID NO: 612 - protein, 10 aa, Artificial Sequence
  Description of Artificial Sequence: Synthetic peptide
QHYESSPSWT

SEQ ID NO: 613 - protein, 10 aa, Artificial Sequence
  Description of Artificial Sequence: Synthetic peptide
QQYGSPPRFT

SEQ ID NO: 614 - protein, 10 aa, Artificial Sequence
  Description of Artificial Sequence: Synthetic peptide
QHYGSSPSWT

SEQ ID NO: 615 - protein, 10 aa, Artificial Sequence
  Description of Artificial Sequence: Synthetic peptide
QHYDSSPSWT

SEQ ID NO: 616 - protein, 10 aa, Artificial Sequence
  Description of Artificial Sequence: Synthetic peptide
QYYGTSPMYT

SEQ ID NO: 617 - protein, 9 aa, Artificial Sequence
  Description of Artificial Sequence: Synthetic peptide
MQALQTPLT

SEQ ID NO: 618 - protein, 11 aa, Artificial Sequence
  Description of Artificial Sequence: Synthetic peptide
QHYGNSPPKFT

SEQ ID NO: 619 - protein, 10 aa, Artificial Sequence
  Description of Artificial Sequence: Synthetic peptide
QHYGGSPRLT

SEQ ID NO: 620 - protein, 9 aa, Artificial Sequence
  Description of Artificial Sequence: Synthetic peptide
QQHYSTPWT

SEQ ID NO: 621 - protein, 9 aa, Artificial Sequence
  Description of Artificial Sequence: Synthetic peptide
LQSRIFPRT

SEQ ID NO: 622 - protein, 9 aa, Artificial Sequence
  Description of Artificial Sequence: Synthetic peptide
LQSRTIPRT

SEQ ID NO: 623 - protein, 9 aa, Artificial Sequence
  Description of Artificial Sequence: Synthetic peptide
LQSRTIPRT

SEQ ID NO: 624 - protein, 7 aa, Artificial Sequence
  Description of Artificial Sequence: Synthetic peptide
GFTFSNY

SEQ ID NO: 625 - protein, 7 aa, Artificial Sequence
  Description of Artificial Sequence: Synthetic peptide
GFTFDDY

SEQ ID NO: 626 - protein, 7 aa, Artificial Sequence
  Description of Artificial Sequence: Synthetic peptide
GFALSNH

SEQ ID NO: 627 - protein, 7 aa, Artificial Sequence
  Description of Artificial Sequence: Synthetic peptide
GYIFDNF

SEQ ID NO: 628 - protein, 7 aa, Artificial Sequence
  Description of Artificial Sequence: Synthetic peptide
GFTFSSD

SEQ ID NO: 629 - protein, 7 aa, Artificial Sequence
  Description of Artificial Sequence: Synthetic peptide
GYTFSNY

SEQ ID NO: 630 - protein, 7 aa, Artificial Sequence
  Description of Artificial Sequence: Synthetic peptide
GFALSNH

SEQ ID NO: 631 - protein, 7 aa, Artificial Sequence
  Description of Artificial Sequence: Synthetic peptide
GFALSNH

SEQ ID NO: 632 - protein, 7 aa, Artificial Sequence
  Description of Artificial Sequence: Synthetic peptide
GFALSNH

SEQ ID NO: 633 - protein, 7 aa, Artificial Sequence
  Description of Artificial Sequence: Synthetic peptide
GFTFSDY

SEQ ID NO: 634 - protein, 7 aa, Artificial Sequence
  Description of Artificial Sequence: Synthetic peptide
GFALSNH

SEQ ID NO: 635 - protein, 7 aa, Artificial Sequence
  Description of Artificial Sequence: Synthetic peptide
GFTFSDY

SEQ ID NO: 636 - protein, 7 aa, Artificial Sequence
  Description of Artificial Sequence: Synthetic peptide
GFALSNH

SEQ ID NO: 637 - protein, 7 aa, Artificial Sequence
  Description of Artificial Sequence: Synthetic peptide
GFALSNH

SEQ ID NO: 638 - protein, 7 aa, Artificial Sequence
  Description of Artificial Sequence: Synthetic peptide
GFALSNH

SEQ ID NO: 639 - protein, 9 aa, Artificial Sequence
  Description of Artificial Sequence: Synthetic peptide
GGSISSSYY

SEQ ID NO: 640 - protein, 9 aa, Artificial Sequence
  Description of Artificial Sequence: Synthetic peptide
GFSLRTSGM

SEQ ID NO: 641 - protein, 7 aa, Artificial Sequence
  Description of Artificial Sequence: Synthetic peptide
GFTFSSY

SEQ ID NO: 642 - protein, 7 aa, Artificial Sequence
  Description of Artificial Sequence: Synthetic peptide
GFTFSDY

SEQ ID NO: 643 - protein, 7 aa, Artificial Sequence
  Description of Artificial Sequence: Synthetic peptide
GYTVTSH

SEQ ID NO: 644 - protein, 9 aa, Artificial Sequence
  Description of Artificial Sequence: Synthetic peptide
GGSISSGGY

SEQ ID NO: 645 - protein, 7 aa, Artificial Sequence
  Description of Artificial Sequence: Synthetic peptide
GGTFSSY

SEQ ID NO: 646 - protein, 9 aa, Artificial Sequence
  Description of Artificial Sequence: Synthetic peptide
GDSVSSNSA

SEQ ID NO: 647 - protein, 7 aa, Artificial Sequence
  Description of Artificial Sequence: Synthetic peptide
GFTFSSY

SEQ ID NO: 648 - protein, 7 aa, Artificial Sequence
  Description of Artificial Sequence: Synthetic peptide
GITFSRY

SEQ ID NO: 649 - protein, 7 aa, Artificial Sequence
  Description of Artificial Sequence: Synthetic peptide
GFTFSSY

SEQ ID NO: 650 - protein, 7 aa, Artificial Sequence
  Description of Artificial Sequence: Synthetic peptide
GFTFSSY

SEQ ID NO: 651 - protein, 7 aa, Artificial Sequence
  Description of Artificial Sequence: Synthetic peptide
GFTFDDY

SEQ ID NO: 652 - protein, 7 aa, Artificial Sequence
  Description of Artificial Sequence: Synthetic peptide
GFTFDDY

SEQ ID NO: 653 - protein, 7 aa, Artificial Sequence
  Description of Artificial Sequence: Synthetic peptide
GFTFSSY

SEQ ID NO: 654 - protein, 7 aa, Artificial Sequence
  Description of Artificial Sequence: Synthetic peptide
GFTFSSY

SEQ ID NO: 655 - protein, 7 aa, Artificial Sequence
  Description of Artificial Sequence: Synthetic peptide
GFTFSSY

SEQ ID NO: 656 - protein, 7 aa, Artificial Sequence
  Description of Artificial Sequence: Synthetic peptide
GFSFSSY

SEQ ID NO: 657 - protein, 7 aa, Artificial Sequence
  Description of Artificial Sequence: Synthetic peptide
GFTFSSY

SEQ ID NO: 658 - protein, 7 aa, Artificial Sequence
  Description of Artificial Sequence: Synthetic peptide
GFTFSSY

SEQ ID NO: 659 - protein, 7 aa, Artificial Sequence
  Description of Artificial Sequence: Synthetic peptide
GFTFSSY

SEQ ID NO: 660 - protein, 7 aa, Artificial Sequence
  Description of Artificial Sequence: Synthetic peptide
GYTFTNF

SEQ ID NO: 661 - protein, 7 aa, Artificial Sequence
  Description of Artificial Sequence: Synthetic peptide
GYTFTDY

SEQ ID NO: 662 - protein, 7 aa, Artificial Sequence
  Description of Artificial Sequence: Synthetic peptide
GYTFRHY

SEQ ID NO: 663 - protein, 7 aa, Artificial Sequence
  Description of Artificial Sequence: Synthetic peptide
GYTFTHY

SEQ ID NO: 664 - protein, 6 aa, Artificial Sequence
  Description of Artificial Sequence: Synthetic peptide
SRSGEN

SEQ ID NO: 665 - protein, 6 aa, Artificial Sequence
  Description of Artificial Sequence: Synthetic peptide
SWNSGS

SEQ ID NO: 666 - protein, 5 aa, Artificial Sequence
  Description of Artificial Sequence: Synthetic peptide
VYSGS

SEQ ID NO: 667 - protein, 6 aa, Artificial Sequence
  Description of Artificial Sequence: Synthetic peptide
NPKNNN

SEQ ID NO: 668 - protein, 6 aa, Artificial Sequence
  Description of Artificial Sequence: Synthetic peptide
SGSGGT

SEQ ID NO: 669 - protein, 6 aa, Artificial Sequence
  Description of Artificial Sequence: Synthetic peptide
SAYNGN

SEQ ID NO: 670 - protein, 5 aa, Artificial Sequence
  Description of Artificial Sequence: Synthetic peptide
VYSGS

SEQ ID NO: 671 - protein, 5 aa, Artificial Sequence
  Description of Artificial Sequence: Synthetic peptide
VYSGS

SEQ ID NO: 672 - protein, 5 aa, Artificial Sequence
  Description of Artificial Sequence: Synthetic peptide
VYSGS

SEQ ID NO: 673 - protein, 6 aa, Artificial Sequence
  Description of Artificial Sequence: Synthetic peptide
SSSGST

SEQ ID NO: 674 - protein, 5 aa, Artificial Sequence
  Description of Artificial Sequence: Synthetic peptide
VYSGS

SEQ ID NO: 675 - protein, 6 aa, Artificial Sequence
  Description of Artificial Sequence: Synthetic peptide
SSSGNT

SEQ ID NO: 676 - protein, 5 aa, Artificial Sequence
  Description of Artificial Sequence: Synthetic peptide
VYSGS

SEQ ID NO: 677 - protein, 5 aa, Artificial Sequence
  Description of Artificial Sequence: Synthetic peptide
VYSGS

SEQ ID NO: 678 - protein, 5 aa, Artificial Sequence
  Description of Artificial Sequence: Synthetic peptide
VYSGS

SEQ ID NO: 679 - protein, 5 aa, Artificial Sequence
  Description of Artificial Sequence: Synthetic peptide
YYSGS

SEQ ID NO: 680 - protein, 5 aa, Artificial Sequence
  Description of Artificial Sequence: Synthetic peptide
DWDED

SEQ ID NO: 681 - protein, 6 aa, Artificial Sequence
  Description of Artificial Sequence: Synthetic peptide
SSSSSY

SEQ ID NO: 682 - protein, 6 aa, Artificial Sequence
  Description of Artificial Sequence: Synthetic peptide
SSSGST

SEQ ID NO: 683 - protein, 6 aa, Artificial Sequence
  Description of Artificial Sequence: Synthetic peptide
NPSGGV

SEQ ID NO: 684 - protein, 5 aa, Artificial Sequence
  Description of Artificial Sequence: Synthetic peptide
YYSGS

SEQ ID NO: 685 - protein, 6 aa, Artificial Sequence
  Description of Artificial Sequence: Synthetic peptide
IPIFGT

SEQ ID NO: 686 - protein, 7 aa, Artificial Sequence
  Description of Artificial Sequence: Synthetic peptide
YYRSKWY

SEQ ID NO: 687 - protein, 6 aa, Artificial Sequence
  Description of Artificial Sequence: Synthetic peptide
SGSGGS

SEQ ID NO: 688 - protein, 6 aa, Artificial Sequence
  Description of Artificial Sequence: Synthetic peptide
SDSGVS

SEQ ID NO: 689 - protein, 6 aa, Artificial Sequence
  Description of Artificial Sequence: Synthetic peptide
SGSGGS

SEQ ID NO: 690 - protein, 6 aa, Artificial Sequence
  Description of Artificial Sequence: Synthetic peptide
SGSGGS

SEQ ID NO: 691 - protein, 6 aa, Artificial Sequence
  Description of Artificial Sequence: Synthetic peptide
SWNSGS

SEQ ID NO: 692 - protein, 6 aa, Artificial Sequence
  Description of Artificial Sequence: Synthetic peptide
NWKGNS

SEQ ID NO: 693 - protein, 6 aa, Artificial Sequence
  Description of Artificial Sequence: Synthetic peptide
SGSGGS

SEQ ID NO: 694 - protein, 6 aa, Artificial Sequence
  Description of Artificial Sequence: Synthetic peptide
SGSGGS

SEQ ID NO: 695 - protein, 6 aa, Artificial Sequence
  Description of Artificial Sequence: Synthetic peptide
SGSGGS

SEQ ID NO: 696 - protein, 6 aa, Artificial Sequence
  Description of Artificial Sequence: Synthetic peptide
SGSGGS

SEQ ID NO: 697 - protein, 6 aa, Artificial Sequence
  Description of Artificial Sequence: Synthetic peptide
SGSGGS

SEQ ID NO: 698 - protein, 6 aa, Artificial Sequence
  Description of Artificial Sequence: Synthetic peptide
SGSGGS

SEQ ID NO: 699 - protein, 6 aa, Artificial Sequence
  Description of Artificial Sequence: Synthetic peptide
SGSGGS

SEQ ID NO: 700 - protein, 6 aa, Artificial Sequence
  Description of Artificial Sequence: Synthetic peptide
NTYTGE

SEQ ID NO: 701 - protein, 6 aa, Artificial Sequence
  Description of Artificial Sequence: Synthetic peptide
NTETRE

SEQ ID NO: 702 - protein, 6 aa, Artificial Sequence
  Description of Artificial Sequence: Synthetic peptide
NTESGV

SEQ ID NO: 703 - protein, 6 aa, Artificial Sequence
  Description of Artificial Sequence: Synthetic peptide
NTETGE

SEQ ID NO: 704 - protein, 11 aa, Artificial Sequence
  Description of Artificial Sequence: Synthetic peptide
SPAHYYGGMDV

SEQ ID NO: 705 - protein, 6 aa, Artificial Sequence
  Description of Artificial Sequence: Synthetic peptide
HSFLAY

SEQ ID NO: 706 - protein, 7 aa, Artificial Sequence
  Description of Artificial Sequence: Synthetic peptide
HGGESDV

SEQ ID NO: 707 - protein, 11 aa, Artificial Sequence
  Description of Artificial Sequence: Synthetic peptide
GPYYYQSYMDV

SEQ ID NO: 708 - protein, 14 aa, Artificial Sequence
  Description of Artificial Sequence: Synthetic peptide
LDSSGYYYARGPRY

SEQ ID NO: 709 - protein, 9 aa, Artificial Sequence
  Description of Artificial Sequence: Synthetic peptide
GPYYYYMDV

SEQ ID NO: 710 - protein, 7 aa, Artificial Sequence
  Description of Artificial Sequence: Synthetic peptide
HGGESDV

SEQ ID NO: 711 - protein, 7 aa, Artificial Sequence
  Description of Artificial Sequence: Synthetic peptide
HGGESDV

SEQ ID NO: 712 - protein, 7 aa, Artificial Sequence
  Description of Artificial Sequence: Synthetic peptide
HGGESDV

SEQ ID NO: 713 - protein, 8 aa, Artificial Sequence
  Description of Artificial Sequence: Synthetic peptide
ESGDGMDV

SEQ ID NO: 714 - protein, 7 aa, Artificial Sequence
  Description of Artificial Sequence: Synthetic peptide
HGGESDV

SEQ ID NO: 715 - protein, 8 aa, Artificial Sequence
  Description of Artificial Sequence: Synthetic peptide
STMVREDY

SEQ ID NO: 716 - protein, 7 aa, Artificial Sequence
  Description of Artificial Sequence: Synthetic peptide
HGGESDV

SEQ ID NO: 717 - protein, 7 aa, Artificial Sequence
  Description of Artificial Sequence: Synthetic peptide
HGGESDV

SEQ ID NO: 718 - protein, 7 aa, Artificial Sequence
  Description of Artificial Sequence: Synthetic peptide
HGGESDV

SEQ ID NO: 719 - protein, 11 aa, Artificial Sequence
  Description of Artificial Sequence: Synthetic peptide
HWQEWPDAFDI

SEQ ID NO: 720 - protein, 13 aa, Artificial Sequence
  Description of Artificial Sequence: Synthetic peptide
SGAGGTSATAFDI

SEQ ID NO: 721 - protein, 10 aa, Artificial Sequence
  Description of Artificial Sequence: Synthetic peptide
TIAAVYAFDI

SEQ ID NO: 722 - protein, 8 aa, Artificial Sequence
  Description of Artificial Sequence: Synthetic peptide
DLRGAFDI

SEQ ID NO: 723 - protein, 11 aa, Artificial Sequence
  Description of Artificial Sequence: Synthetic peptide
EGSGSGWYFDF

SEQ ID NO: 724 - protein, 13 aa, Artificial Sequence
  Description of Artificial Sequence: Synthetic peptide
AGIAARLRGAFDI

SEQ ID NO: 725 - protein, 20 aa, Artificial Sequence
  Description of Artificial Sequence: Synthetic peptide
RGGYQLLRWDVGLLRSAFDI

SEQ ID NO: 726 - protein, 13 aa, Artificial Sequence
  Description of Artificial Sequence: Synthetic peptide
SSPEGLFLYWFDP

SEQ ID NO: 727 - protein, 9 aa, Artificial Sequence
  Description of Artificial Sequence: Synthetic peptide
VEGSGSLDY

SEQ ID NO: 728 - protein, 9 aa, Artificial Sequence
  Description of Artificial Sequence: Synthetic peptide
RAGSEASDI

SEQ ID NO: 729 - protein, 15 aa, Artificial Sequence
  Description of Artificial Sequence: Synthetic peptide
ATYKRELRYYYGMDV

SEQ ID NO: 730 - protein, 15 aa, Artificial Sequence
  Description of Artificial Sequence: Synthetic peptide
ATYKRELRYYYGMDV

SEQ ID NO: 731 - protein, 8 aa, Artificial Sequence
  Description of Artificial Sequence: Synthetic peptide
VGKAVPDV

SEQ ID NO: 732 - protein, 13 aa, Artificial Sequence
  Description of Artificial Sequence: Synthetic peptide
HQGVAYYNYAMDV

SEQ ID NO: 733 - protein, 8 aa, Artificial Sequence
  Description of Artificial Sequence: Synthetic peptide
VVRDGMDV

SEQ ID NO: 734 - protein, 9 aa, Artificial Sequence
  Description of Artificial Sequence: Synthetic peptide
IPQTGTFDY

SEQ ID NO: 735 - protein, 15 aa, Artificial Sequence
  Description of Artificial Sequence: Synthetic peptide
ANYKRELRYYYGMDV

SEQ ID NO: 736 - protein, 11 aa, Artificial Sequence
  Description of Artificial Sequence: Synthetic peptide
ALVGATGAFDI

SEQ ID NO: 737 - protein, 8 aa, Artificial Sequence
  Description of Artificial Sequence: Synthetic peptide
WFGEGFDP

SEQ ID NO: 738 - protein, 17 aa, Artificial Sequence
  Description of Artificial Sequence: Synthetic peptide
VGYDSSGYYRDYYGMDV

SEQ ID NO: 739 - protein, 13 aa, Artificial Sequence
  Description of Artificial Sequence: Synthetic peptide
MGWSSGYLGAFDI

SEQ ID NO: 740 - protein, 13 aa, Artificial Sequence
  Description of Artificial Sequence: Synthetic peptide
GEIYYGYDGGFAY

SEQ ID NO: 741 - protein, 8 aa, Artificial Sequence
  Description of Artificial Sequence: Synthetic peptide
DYSYAMDY

SEQ ID NO: 742 - protein, 8 aa, Artificial Sequence
  Description of Artificial Sequence: Synthetic peptide
DYLYSLDF

SEQ ID NO: 743 - protein, 8 aa, Artificial Sequence
  Description of Artificial Sequence: Synthetic peptide
DYLYSCDY

SEQ ID NO: 744 - protein, 8 aa, Artificial Sequence
  Description of Artificial Sequence: Synthetic peptide
SQSISSSF

SEQ ID NO: 745 - protein, 12 aa, Artificial Sequence
  Description of Artificial Sequence: Synthetic peptide
SQSLLHSNGYNY

SEQ ID NO: 746 - protein, 12 aa, Artificial Sequence
  Description of Artificial Sequence: Synthetic peptide
SQSLLRNDGKTP

SEQ ID NO: 747 - protein, 12 aa, Artificial Sequence
  Description of Artificial Sequence: Synthetic peptide
SQSLLHSNGYNY

SEQ ID NO: 748 - protein, 7 aa, Artificial Sequence
  Description of Artificial Sequence: Synthetic peptide
SQSISSY

SEQ ID NO: 749 - protein, 12 aa, Artificial Sequence
  Description of Artificial Sequence: Synthetic peptide
SQSLLYSNGYNY

SEQ ID NO: 750 - protein, 7 aa, Artificial Sequence
  Description of Artificial Sequence: Synthetic peptide
SQSVSSN

SEQ ID NO: 751 - protein, 7 aa, Artificial Sequence
  Description of Artificial Sequence: Synthetic peptide
SQSVSSK

SEQ ID NO: 752 - protein, 8 aa, Artificial Sequence
  Description of Artificial Sequence: Synthetic peptide
SQSVGSTN

SEQ ID NO: 753 - protein, 7 aa, Artificial Sequence
  Description of Artificial Sequence: Synthetic peptide
SQSISSY

SEQ ID NO: 754 - protein, 7 aa, Artificial Sequence
  Description of Artificial Sequence: Synthetic peptide
SQSISSY

SEQ ID NO: 755 - protein, 12 aa, Artificial Sequence
  Description of Artificial Sequence: Synthetic peptide
SESLVHNSGKTY

SEQ ID NO: 756 - protein, 7 aa, Artificial Sequence
  Description of Artificial Sequence: Synthetic peptide
SEDINKF

SEQ ID NO: 757 - protein, 7 aa, Artificial Sequence
  Description of Artificial Sequence: Synthetic peptide
SQSVGSN

SEQ ID NO: 758 - protein, 8 aa, Artificial Sequence
  Description of Artificial Sequence: Synthetic peptide
SQSIGSSS

SEQ ID NO: 759 - protein, 7 aa, Artificial Sequence
  Description of Artificial Sequence: Synthetic peptide
SQDIDDA

SEQ ID NO: 760 - protein, 7 aa, Artificial Sequence
  Description of Artificial Sequence: Synthetic peptide
SQDIYNN

SEQ ID NO: 761 - protein, 12 aa, Artificial Sequence
  Description of Artificial Sequence: Synthetic peptide
SQSLLHSNGYNY

SEQ ID NO: 762 - protein, 7 aa, Artificial Sequence
  Description of Artificial Sequence: Synthetic peptide
NNIGTKS

SEQ ID NO: 763 - protein, 7 aa, Artificial Sequence
  Description of Artificial Sequence: Synthetic peptide
DGLSKKY

SEQ ID NO: 764 - protein, 7 aa, Artificial Sequence
  Description of Artificial Sequence: Synthetic peptide
SQGIRNW

SEQ ID NO: 765 - protein, 7 aa, Artificial Sequence
  Description of Artificial Sequence: Synthetic peptide
NNIGSKS

SEQ ID NO: 766 - protein, 7 aa, Artificial Sequence
  Description of Artificial Sequence: Synthetic peptide
DSLGNYY

SEQ ID NO: 767 - protein, 8 aa, Artificial Sequence
  Description of Artificial Sequence: Synthetic peptide
SQSVSSAY

SEQ ID NO: 768 - protein, 7 aa, Artificial Sequence
  Description of Artificial Sequence: Synthetic peptide
SQSVSNS

SEQ ID NO: 769 - protein, 8 aa, Artificial Sequence
  Description of Artificial Sequence: Synthetic peptide
SQSVSSSF

SEQ ID NO: 770 - protein, 8 aa, Artificial Sequence
  Description of Artificial Sequence: Synthetic peptide
SQSVSTTF

SEQ ID NO: 771 - protein, 7 aa, Artificial Sequence
  Description of Artificial Sequence: Synthetic peptide
SQSISSY

SEQ ID NO: 772 - protein, 8 aa, Artificial Sequence
  Description of Artificial Sequence: Synthetic peptide
TQSIGSSF

SEQ ID NO: 773 - protein, 8 aa, Artificial Sequence
  Description of Artificial Sequence: Synthetic peptide
SQSVSSSY

SEQ ID NO: 774 - protein, 8 aa, Artificial Sequence
  Description of Artificial Sequence: Synthetic peptide
SQSVSSSY

SEQ ID NO: 775 - protein, 8 aa, Artificial Sequence
  Description of Artificial Sequence: Synthetic peptide
SQRVASNY

SEQ ID NO: 776 - protein, 8 aa, Artificial Sequence
  Description of Artificial Sequence: Synthetic peptide
SQSLSSNF

SEQ ID NO: 777 - protein, 12 aa, Artificial Sequence
  Description of Artificial Sequence: Synthetic peptide
SQSLLHSNGYNY

SEQ ID NO: 778 - protein, 8 aa, Artificial Sequence
  Description of Artificial Sequence: Synthetic peptide
SQSVSSSY

SEQ ID NO: 779 - protein, 8 aa, Artificial Sequence
  Description of Artificial Sequence: Synthetic peptide
SQSVASSF

SEQ ID NO: 780 - protein, 7 aa, Artificial Sequence
  Description of Artificial Sequence: Synthetic peptide
SQDVNTA

SEQ ID NO: 781 - protein, 11 aa, Artificial Sequence
  Description of Artificial Sequence: Synthetic peptide
SESVSVIGAHL

SEQ ID NO: 782 - protein, 11 aa, Artificial Sequence
  Description of Artificial Sequence: Synthetic peptide
SESVTILGSHL

SEQ ID NO: 783 - protein, 11 aa, Artificial Sequence
  Description of Artificial Sequence: Synthetic peptide
SESVTILGSHL

SEQ ID NO: 784 - protein, 3 aa, Artificial Sequence
  Description of Artificial Sequence: Synthetic peptide
GAS

SEQ ID NO: 785 - protein, 3 aa, Artificial Sequence
  Description of Artificial Sequence: Synthetic peptide
LGS

SEQ ID NO: 786 - protein, 3 aa, Artificial Sequence
  Description of Artificial Sequence: Synthetic peptide
EVS

SEQ ID NO: 787 - protein, 3 aa, Artificial Sequence
  Description of Artificial Sequence: Synthetic peptide
LGS

SEQ ID NO: 788 - protein, 3 aa, Artificial Sequence
  Description of Artificial Sequence: Synthetic peptide
GAS

SEQ ID NO: 789 - protein, 3 aa, Artificial Sequence
  Description of Artificial Sequence: Synthetic peptide
LGS

SEQ ID NO: 790 - protein, 3 aa, Artificial Sequence
  Description of Artificial Sequence: Synthetic peptide
GAS

SEQ ID NO: 791 - protein, 3 aa, Artificial Sequence
  Description of Artificial Sequence: Synthetic peptide
GAS

SEQ ID NO: 792 - protein, 3 aa, Artificial Sequence
  Description of Artificial Sequence: Synthetic peptide
DAS

SEQ ID NO: 793 - protein, 3 aa, Artificial Sequence
  Description of Artificial Sequence: Synthetic peptide
AAS

SEQ ID NO: 794 - protein, 3 aa, Artificial Sequence
  Description of Artificial Sequence: Synthetic peptide
AAS

SEQ ID NO: 795 - protein, 3 aa, Artificial Sequence
  Description of Artificial Sequence: Synthetic peptide
EVS

SEQ ID NO: 796 - protein, 3 aa, Artificial Sequence
  Description of Artificial Sequence: Synthetic peptide
DAS

SEQ ID NO: 797 - protein, 3 aa, Artificial Sequence
  Description of Artificial Sequence: Synthetic peptide
GAS

SEQ ID NO: 798 - protein, 3 aa, Artificial Sequence
  Description of Artificial Sequence: Synthetic peptide
GAS

SEQ ID NO: 799 - protein, 3 aa, Artificial Sequence
  Description of Artificial Sequence: Synthetic peptide
SAT

SEQ ID NO: 800 - protein, 3 aa, Artificial Sequence
  Description of Artificial Sequence: Synthetic peptide
AAN

SEQ ID NO: 801 - protein, 3 aa, Artificial Sequence
  Description of Artificial Sequence: Synthetic peptide
LGS

SEQ ID NO: 802 - protein, 3 aa, Artificial Sequence
  Description of Artificial Sequence: Synthetic peptide
DDS

SEQ ID NO: 803 - protein, 3 aa, Artificial Sequence
  Description of Artificial Sequence: Synthetic peptide
RDK

SEQ ID NO: 804 - protein, 3 aa, Artificial Sequence
  Description of Artificial Sequence: Synthetic peptide
AAS

SEQ ID NO: 805 - protein, 3 aa, Artificial Sequence
  Description of Artificial Sequence: Synthetic peptide
GKN

SEQ ID NO: 806 - protein, 3 aa, Artificial Sequence
  Description of Artificial Sequence: Synthetic peptide
GTN

SEQ ID NO: 807 - protein, 3 aa, Artificial Sequence
  Description of Artificial Sequence: Synthetic peptide
GAS

SEQ ID NO: 808 - protein, 3 aa, Artificial Sequence
  Description of Artificial Sequence: Synthetic peptide
DAS

SEQ ID NO: 809 - protein, 3 aa, Artificial Sequence
  Description of Artificial Sequence: Synthetic peptide
GAS

SEQ ID NO: 810 - protein, 3 aa, Artificial Sequence
  Description of Artificial Sequence: Synthetic peptide
GSS

SEQ ID NO: 811 - protein, 3 aa, Artificial Sequence
  Description of Artificial Sequence: Synthetic peptide
AAS

SEQ ID NO: 812 - protein, 3 aa, Artificial Sequence
  Description of Artificial Sequence: Synthetic peptide
GAS

SEQ ID NO: 813 - protein, 3 aa, Artificial Sequence
  Description of Artificial Sequence: Synthetic peptide
GAS

SEQ ID NO: 814 - protein, 3 aa, Artificial Sequence
  Description of Artificial Sequence: Synthetic peptide
GAS

SEQ ID NO: 815 - protein, 3 aa, Artificial Sequence
  Description of Artificial Sequence: Synthetic peptide
GAS

SEQ ID NO: 816 - protein, 3 aa, Artificial Sequence
  Description of Artificial Sequence: Synthetic peptide
GAS

SEQ ID NO: 817 - protein, 3 aa, Artificial Sequence
  Description of Artificial Sequence: Synthetic peptide
LGS

SEQ ID NO: 818 - protein, 3 aa, Artificial Sequence
  Description of Artificial Sequence: Synthetic peptide
GTS

SEQ ID NO: 819 - protein, 3 aa, Artificial Sequence
  Description of Artificial Sequence: Synthetic peptide
GAS

SEQ ID NO: 820 - protein, 3 aa, Artificial Sequence
  Description of Artificial Sequence: Synthetic peptide
SAS

SEQ ID NO: 821 - protein, 3 aa, Artificial Sequence
  Description of Artificial Sequence: Synthetic peptide
LAS

SEQ ID NO: 822 - protein, 3 aa, Artificial Sequence
  Description of Artificial Sequence: Synthetic peptide
LAS

SEQ ID NO: 823 - protein, 3 aa, Artificial Sequence
  Description of Artificial Sequence: Synthetic peptide
LAS

SEQ ID NO: 824 - protein, 7 aa, Artificial Sequence
  Description of Artificial Sequence: Synthetic peptide
YHSSPSW

SEQ ID NO: 825 - protein, 6 aa, Artificial Sequence
  Description of Artificial Sequence: Synthetic peptide
ALQTPY

SEQ ID NO: 826 - protein, 5 aa, Artificial Sequence
  Description of Artificial Sequence: Synthetic peptide
NIQFP

SEQ ID NO: 827 - protein, 6 aa, Artificial Sequence
  Description of Artificial Sequence: Synthetic peptide
ALQTPY

SEQ ID NO: 828 - protein, 5 aa, Artificial Sequence
  Description of Artificial Sequence: Synthetic peptide
SYKRA

SEQ ID NO: 829 - protein, 6 aa, Artificial Sequence
  Description of Artificial Sequence: Synthetic peptide
GRQFPY

SEQ ID NO: 830 - protein, 5 aa, Artificial Sequence
  Description of Artificial Sequence: Synthetic peptide
YGSSL

SEQ ID NO: 831 - protein, 6 aa, Artificial Sequence
  Description of Artificial Sequence: Synthetic peptide
YGSSSW

SEQ ID NO: 832 - protein, 7 aa, Artificial Sequence
  Description of Artificial Sequence: Synthetic peptide
YGSSPPW

SEQ ID NO: 833 - protein, 4 aa, Artificial Sequence
  Description of Artificial Sequence: Synthetic peptide
SYTL

SEQ ID NO: 834 - protein, 6 aa, Artificial Sequence
  Description of Artificial Sequence: Synthetic peptide
SYSTPY

SEQ ID NO: 835 - protein, 6 aa, Artificial Sequence
  Description of Artificial Sequence: Synthetic peptide
GTHWPG

SEQ ID NO: 836 - protein, 6 aa, Artificial Sequence
  Description of Artificial Sequence: Synthetic peptide
YESLPL

SEQ ID NO: 837 - protein, 7 aa, Artificial Sequence
  Description of Artificial Sequence: Synthetic peptide
YNDWLPV

SEQ ID NO: 838 - protein, 7 aa, Artificial Sequence
  Description of Artificial Sequence: Synthetic peptide
YAGSPPF

SEQ ID NO: 839 - protein, 6 aa, Artificial Sequence
  Description of Artificial Sequence: Synthetic peptide
HDNFPL

SEQ ID NO: 840 - protein, 6 aa, Artificial Sequence
  Description of Artificial Sequence: Synthetic peptide
YYRFPY

SEQ ID NO: 841 - protein, 6 aa, Artificial Sequence
  Description of Artificial Sequence: Synthetic peptide
ALQTPY

SEQ ID NO: 842 - protein, 8 aa, Artificial Sequence
  Description of Artificial Sequence: Synthetic peptide
WDSDSEHV

SEQ ID NO: 843 - protein, 6 aa, Artificial Sequence
  Description of Artificial Sequence: Synthetic peptide
WDDTTV

SEQ ID NO: 844 - protein, 6 aa, Artificial Sequence
  Description of Artificial Sequence: Synthetic peptide
YNSAPF

SEQ ID NO: 845 - protein, 9 aa, Artificial Sequence
  Description of Artificial Sequence: Synthetic peptide
RDSSGDHLR

SEQ ID NO: 846 - protein, 8 aa, Artificial Sequence
  Description of Artificial Sequence: Synthetic peptide
RDSSGHHL

SEQ ID NO: 847 - protein, 11 aa, Artificial Sequence
  Description of Artificial Sequence: Synthetic peptide
YGSSFNGSSLF

SEQ ID NO: 848 - protein, 7 aa, Artificial Sequence
  Description of Artificial Sequence: Synthetic peptide
FGTSSGL

SEQ ID NO: 849 - protein, 7 aa, Artificial Sequence
  Description of Artificial Sequence: Synthetic peptide
YHSSPSW

SEQ ID NO: 850 - protein, 7 aa, Artificial Sequence
  Description of Artificial Sequence: Synthetic peptide
YHSSPSW

SEQ ID NO: 851 - protein, 6 aa, Artificial Sequence
  Description of Artificial Sequence: Synthetic peptide
SYSTPY

SEQ ID NO: 852 - protein, 7 aa, Artificial Sequence
  Description of Artificial Sequence: Synthetic peptide
YESSPSW

SEQ ID NO: 853 - protein, 7 aa, Artificial Sequence
  Description of Artificial Sequence: Synthetic peptide
YGSPPRF

SEQ ID NO: 854 - protein, 7 aa, Artificial Sequence
  Description of Artificial Sequence: Synthetic peptide
YGSSPSW

SEQ ID NO: 855 - protein, 7 aa, Artificial Sequence
  Description of Artificial Sequence: Synthetic peptide
YDSSPSW

SEQ ID NO: 856 - protein, 7 aa, Artificial Sequence
  Description of Artificial Sequence: Synthetic peptide
YGTSPMY

SEQ ID NO: 857 - protein, 6 aa, Artificial Sequence
  Description of Artificial Sequence: Synthetic peptide
ALQTPL

SEQ ID NO: 858 - protein, 8 aa, Artificial Sequence
  Description of Artificial Sequence: Synthetic peptide
YGNSPPKF

SEQ ID NO: 859 - protein, 7 aa, Artificial Sequence
  Description of Artificial Sequence: Synthetic peptide
YGGSPRL

SEQ ID NO: 860 - protein, 6 aa, Artificial Sequence
  Description of Artificial Sequence: Synthetic peptide
HYSTPW

SEQ ID NO: 861 - protein, 6 aa, Artificial Sequence
  Description of Artificial Sequence: Synthetic peptide
SRIFPR

SEQ ID NO: 862 - protein, 6 aa, Artificial Sequence
  Description of Artificial Sequence: Synthetic peptide
SRTIPR

SEQ ID NO: 863 - protein, 6 aa, Artificial Sequence
  Description of Artificial Sequence: Synthetic peptide
SRTIPR

SEQ ID NO: 864 - protein, 10 aa, Artificial Sequence
  Description of Artificial Sequence: Synthetic peptide
GFTFSNYAMS

SEQ ID NO: 865 - protein, 10 aa, Artificial Sequence
  Description of Artificial Sequence: Synthetic peptide
GFTFDDYAMH

SEQ ID NO: 866 - protein, 10 aa, Artificial Sequence
  Description of Artificial Sequence: Synthetic peptide
GFALSNHGMS

SEQ ID NO: 867 - protein, 10 aa, Artificial Sequence
  Description of Artificial Sequence: Synthetic peptide
GYIFDNFGIN

SEQ ID NO: 868 - protein, 10 aa, Artificial Sequence
  Description of Artificial Sequence: Synthetic peptide
GFTFSSDAMT

SEQ ID NO: 869 - protein, 10 aa, Artificial Sequence
  Description of Artificial Sequence: Synthetic peptide
GYTFSNYGIT

SEQ ID NO: 870 - protein, 10 aa, Artificial Sequence
  Description of Artificial Sequence: Synthetic peptide
GFALSNHGMS

SEQ ID NO: 871 - protein, 10 aa, Artificial Sequence
  Description of Artificial Sequence: Synthetic peptide
GFALSNHGMS

SEQ ID NO: 872 - protein, 10 aa, Artificial Sequence
  Description of Artificial Sequence: Synthetic peptide
GFALSNHGMS

SEQ ID NO: 873 - protein, 10 aa, Artificial Sequence
  Description of Artificial Sequence: Synthetic peptide
GFTFSDYYMS

SEQ ID NO: 874 - protein, 10 aa, Artificial Sequence
  Description of Artificial Sequence: Synthetic peptide
GFALSNHGMS

SEQ ID NO: 875 - protein, 10 aa, Artificial Sequence
  Description of Artificial Sequence: Synthetic peptide
GFTFSDYYMS

SEQ ID NO: 876 - protein, 10 aa, Artificial Sequence
  Description of Artificial Sequence: Synthetic peptide
GFALSNHGMS

SEQ ID NO: 877 - protein, 10 aa, Artificial Sequence
  Description of Artificial Sequence: Synthetic peptide
GFALSNHGMS

SEQ ID NO: 878 - protein, 10 aa, Artificial Sequence
  Description of Artificial Sequence: Synthetic peptide
GFALSNHGMS

SEQ ID NO: 879 - protein, 12 aa, Artificial Sequence
  Description of Artificial Sequence: Synthetic peptide
GGSISSSYYYWG

SEQ ID NO: 880 - protein, 12 aa, Artificial Sequence
  Description of Artificial Sequence: Synthetic peptide
GFSLRTSGMCVS

SEQ ID NO: 881 - protein, 10 aa, Artificial Sequence
  Description of Artificial Sequence: Synthetic peptide
GFTFSSYSMN

SEQ ID NO: 882 - protein, 10 aa, Artificial Sequence
  Description of Artificial Sequence: Synthetic peptide
GFTFSDYYMS

SEQ ID NO: 883 - protein, 10 aa, Artificial Sequence
  Description of Artificial Sequence: Synthetic peptide
GYTVTSHYIH

SEQ ID NO: 884 - protein, 12 aa, Artificial Sequence
  Description of Artificial Sequence: Synthetic peptide
GGSISSGGYYWS

SEQ ID NO: 885 - protein, 10 aa, Artificial Sequence
  Description of Artificial Sequence: Synthetic peptide
GGTFSSYAIS

SEQ ID NO: 886 - protein, 12 aa, Artificial Sequence
  Description of Artificial Sequence: Synthetic peptide
GDSVSSNSAAWN

SEQ ID NO: 887 - protein, 10 aa, Artificial Sequence
  Description of Artificial Sequence: Synthetic peptide
GFTFSSYAMS

SEQ ID NO: 888 - protein, 10 aa, Artificial Sequence
  Description of Artificial Sequence: Synthetic peptide
GITFSRYPMS

SEQ ID NO: 889 - protein, 10 aa, Artificial Sequence
  Description of Artificial Sequence: Synthetic peptide
GFTFSSYAMS

SEQ ID NO: 890 - protein, 10 aa, Artificial Sequence
  Description of Artificial Sequence: Synthetic peptide
GFTFSSYAMS

SEQ ID NO: 891 - protein, 10 aa, Artificial Sequence
  Description of Artificial Sequence: Synthetic peptide
GFTFDDYAMH

SEQ ID NO: 892 - protein, 10 aa, Artificial Sequence
  Description of Artificial Sequence: Synthetic peptide
GFTFDDYAMH

SEQ ID NO: 893 - protein, 10 aa, Artificial Sequence
  Description of Artificial Sequence: Synthetic peptide
GFTFSSYAMS

SEQ ID NO: 894 - protein, 10 aa, Artificial Sequence
  Description of Artificial Sequence: Synthetic peptide
GFTFSSYAMS

SEQ ID NO: 895 - protein, 10 aa, Artificial Sequence
  Description of Artificial Sequence: Synthetic peptide
GFTFSSYAMS

SEQ ID NO: 896 - protein, 10 aa, Artificial Sequence
  Description of Artificial Sequence: Synthetic peptide
GFSFSSYAMS

SEQ ID NO: 897 - protein, 10 aa, Artificial Sequence
  Description of Artificial Sequence: Synthetic peptide
GFTFSSYAMS

SEQ ID NO: 898 - protein, 10 aa, Artificial Sequence
  Description of Artificial Sequence: Synthetic peptide
GFTFSSYAMS

SEQ ID NO: 899 - protein, 10 aa, Artificial Sequence
  Description of Artificial Sequence: Synthetic peptide
GFTFSSYAMS

SEQ ID NO: 900 - protein, 10 aa, Artificial Sequence
  Description of Artificial Sequence: Synthetic peptide
GYTFTNFGMN

SEQ ID NO: 901 - protein, 10 aa, Artificial Sequence
  Description of Artificial Sequence: Synthetic peptide
GYTFTDYSIN

SEQ ID NO: 902 - protein, 10 aa, Artificial Sequence
  Description of Artificial Sequence: Synthetic peptide
GYTFRHYSMN

SEQ ID NO: 903 - protein, 10 aa, Artificial Sequence
  Description of Artificial Sequence: Synthetic peptide
GYTFTHYSMN

SEQ ID NO: 904 - protein, 17 aa, Artificial Sequence
  Description of Artificial Sequence: Synthetic peptide
GISRSGENTYYADSVKG

SEQ ID NO: 905 - protein, 17 aa, Artificial Sequence
  Description of Artificial Sequence: Synthetic peptide
GISWNSGSIGYADSVKG

SEQ ID NO: 906 - protein, 16 aa, Artificial Sequence
  Description of Artificial Sequence: Synthetic peptide
GIVYSGSTYYAASVKG

SEQ ID NO: 907 - protein, 17 aa, Artificial Sequence
  Description of Artificial Sequence: Synthetic peptide
WINPKNNNTNYAQKFQG

SEQ ID NO: 908 - protein, 17 aa, Artificial Sequence
  Description of Artificial Sequence: Synthetic peptide
VISGSGGTTYYADSVKG

SEQ ID NO: 909 - protein, 17 aa, Artificial Sequence
  Description of Artificial Sequence: Synthetic peptide
WISAYNGNTNYAQKFQG

SEQ ID NO: 910 - protein, 16 aa, Artificial Sequence
  Description of Artificial Sequence: Synthetic peptide
GIVYSGSTYYAASVKG

SEQ ID NO: 911 - protein, 16 aa, Artificial Sequence
  Description of Artificial Sequence: Synthetic peptide
GIVYSGSTYYAASVKG

SEQ ID NO: 912 - protein, 16 aa, Artificial Sequence
  Description of Artificial Sequence: Synthetic peptide
GIVYSGSTYYAASVKG

SEQ ID NO: 913 - protein, 17 aa, Artificial Sequence
  Description of Artificial Sequence: Synthetic peptide
YISSSGSTIYYADSVKG

SEQ ID NO: 914 - protein, 16 aa, Artificial Sequence
  Description of Artificial Sequence: Synthetic peptide
GIVYSGSTYYAASVKG

SEQ ID NO: 915 - protein, 17 aa, Artificial Sequence
  Description of Artificial Sequence: Synthetic peptide
YISSSGNTIYYADSVKG

SEQ ID NO: 916 - protein, 16 aa, Artificial Sequence
  Description of Artificial Sequence: Synthetic peptide
GIVYSGSTYYAASVKG

SEQ ID NO: 917 - protein, 16 aa, Artificial Sequence
  Description of Artificial Sequence: Synthetic peptide
GIVYSGSTYYAASVKG

SEQ ID NO: 918 - protein, 16 aa, Artificial Sequence
  Description of Artificial Sequence: Synthetic peptide
GIVYSGSTYYAASVKG

SEQ ID NO: 919 - protein, 16 aa, Artificial Sequence
  Description of Artificial Sequence: Synthetic peptide
SIYYSGSAYYNPSLKS

SEQ ID NO: 920 - protein, 16 aa, Artificial Sequence
  Description of Artificial Sequence: Synthetic peptide
RIDWDEDKFYSTSLKT

SEQ ID NO: 921 - protein, 17 aa, Artificial Sequence
  Description of Artificial Sequence: Synthetic peptide
SISSSSSYIYYADSVKG

SEQ ID NO: 922 - protein, 17 aa, Artificial Sequence
  Description of Artificial Sequence: Synthetic peptide
YISSSGSTIYYADSVKG

SEQ ID NO: 923 - protein, 17 aa, Artificial Sequence
  Description of Artificial Sequence: Synthetic peptide
MINPSGGVTAYSQTLQG

SEQ ID NO: 924 - protein, 16 aa, Artificial Sequence
  Description of Artificial Sequence: Synthetic peptide
YIYYSGSTYYNPSLKS

SEQ ID NO: 925 - protein, 17 aa, Artificial Sequence
  Description of Artificial Sequence: Synthetic peptide
GIIPIFGTANYAQKFQG

SEQ ID NO: 926 - protein, 18 aa, Artificial Sequence
  Description of Artificial Sequence: Synthetic peptide
RTYYRSKWYSFYAISLKS

SEQ ID NO: 927 - protein, 17 aa, Artificial Sequence
  Description of Artificial Sequence: Synthetic peptide
AISGSGGSTYYADSVKG

SEQ ID NO: 928 - protein, 17 aa, Artificial Sequence
  Description of Artificial Sequence: Synthetic peptide
GISDSGVSTYYADSAKG

SEQ ID NO: 929 - protein, 17 aa, Artificial Sequence
  Description of Artificial Sequence: Synthetic peptide
AISGSGGSTYYADSVKG

SEQ ID NO: 930 - protein, 17 aa, Artificial Sequence
  Description of Artificial Sequence: Synthetic peptide
AISGSGGSTYYADSVKG

SEQ ID NO: 931 - protein, 17 aa, Artificial Sequence
  Description of Artificial Sequence: Synthetic peptide
GISWNSGSIGYADSVKG

SEQ ID NO: 932 - protein, 17 aa, Artificial Sequence
  Description of Artificial Sequence: Synthetic peptide
SINWKGNSLAYGDSVKG

SEQ ID NO: 933 - protein, 17 aa, Artificial Sequence
  Description of Artificial Sequence: Synthetic peptide
AISGSGGSTYYADSVKG

SEQ ID NO: 934 - protein, 17 aa, Artificial Sequence
  Description of Artificial Sequence: Synthetic peptide
AISGSGGSTYYADSVKG

SEQ ID NO: 935 - protein, 17 aa, Artificial Sequence
  Description of Artificial Sequence: Synthetic peptide
AISGSGGSTYYADSVKG

SEQ ID NO: 936 - protein, 17 aa, Artificial Sequence
  Description of Artificial Sequence: Synthetic peptide
AISGSGGSTYYADSVKG

SEQ ID NO: 937 - protein, 17 aa, Artificial Sequence
  Description of Artificial Sequence: Synthetic peptide
AISGSGGSTYYADSVKG

SEQ ID NO: 938 - protein, 17 aa, Artificial Sequence
  Description of Artificial Sequence: Synthetic peptide
AISGSGGSTYYADSVKG

SEQ ID NO: 939 - protein, 17 aa, Artificial Sequence
  Description of Artificial Sequence: Synthetic peptide
AISGSGGSTYYADSVKG

SEQ ID NO: 940 - protein, 17 aa, Artificial Sequence
  Description of Artificial Sequence: Synthetic peptide
WINTYTGESYFADDFKG

SEQ ID NO: 941 - protein, 17 aa, Artificial Sequence
  Description of Artificial Sequence: Synthetic peptide
WINTETREPAYAYDFRG

SEQ ID NO: 942 - protein, 17 aa, Artificial Sequence
  Description of Artificial Sequence: Synthetic peptide
RINTESGVPIYADDFKG

SEQ ID NO: 943 - protein, 17 aa, Artificial Sequence
  Description of Artificial Sequence: Synthetic peptide
RINTETGEPLYADDFKG

SEQ ID NO: 944 - protein, 11 aa, Artificial Sequence
  Description of Artificial Sequence: Synthetic peptide
SPAHYYGGMDV

SEQ ID NO: 945 - protein, 6 aa, Artificial Sequence
  Description of Artificial Sequence: Synthetic peptide
HSFLAY

SEQ ID NO: 946 - protein, 7 aa, Artificial Sequence
  Description of Artificial Sequence: Synthetic peptide
HGGESDV

SEQ ID NO: 947 - protein, 11 aa, Artificial Sequence
  Description of Artificial Sequence: Synthetic peptide
GPYYYQSYMDV

SEQ ID NO: 948 - protein, 14 aa, Artificial Sequence
  Description of Artificial Sequence: Synthetic peptide
LDSSGYYYARGPRY

SEQ ID NO: 949 - protein, 9 aa, Artificial Sequence
  Description of Artificial Sequence: Synthetic peptide
GPYYYYMDV

SEQ ID NO: 950 - protein, 7 aa, Artificial Sequence
  Description of Artificial Sequence: Synthetic peptide
HGGESDV

SEQ ID NO: 951 - protein, 7 aa, Artificial Sequence
  Description of Artificial Sequence: Synthetic peptide
HGGESDV

SEQ ID NO: 952 - protein, 7 aa, Artificial Sequence
  Description of Artificial Sequence: Synthetic peptide
HGGESDV

SEQ ID NO: 953 - protein, 8 aa, Artificial Sequence
  Description of Artificial Sequence: Synthetic peptide
ESGDGMDV

SEQ ID NO: 954 - protein, 7 aa, Artificial Sequence
  Description of Artificial Sequence: Synthetic peptide
HGGESDV

SEQ ID NO: 955 - protein, 8 aa, Artificial Sequence
  Description of Artificial Sequence: Synthetic peptide
STMVREDY

SEQ ID NO: 956 - protein, 7 aa, Artificial Sequence
  Description of Artificial Sequence: Synthetic peptide
HGGESDV

SEQ ID NO: 957 - protein, 7 aa, Artificial Sequence
  Description of Artificial Sequence: Synthetic peptide
HGGESDV

SEQ ID NO: 958 - protein, 7 aa, Artificial Sequence
  Description of Artificial Sequence: Synthetic peptide
HGGESDV

SEQ ID NO: 959 - protein, 11 aa, Artificial Sequence
  Description of Artificial Sequence: Synthetic peptide
HWQEWPDAFDI

SEQ ID NO: 960 - protein, 13 aa, Artificial Sequence
  Description of Artificial Sequence: Synthetic peptide
SGAGGTSATAFDI

SEQ ID NO: 961 - protein, 10 aa, Artificial Sequence
  Description of Artificial Sequence: Synthetic peptide
TIAAVYAFDI

SEQ ID NO: 962 - protein, 8 aa, Artificial Sequence
  Description of Artificial Sequence: Synthetic peptide
DLRGAFDI

SEQ ID NO: 963 - protein, 11 aa, Artificial Sequence
  Description of Artificial Sequence: Synthetic peptide
EGSGSGWYFDF

SEQ ID NO: 964 - protein, 13 aa, Artificial Sequence
  Description of Artificial Sequence: Synthetic peptide
AGIAARLRGAFDI

SEQ ID NO: 965 - protein, 20 aa, Artificial Sequence
  Description of Artificial Sequence: Synthetic peptide
RGGYQLLRWDVGLLRSAFDI

SEQ ID NO: 966 - protein, 13 aa, Artificial Sequence
  Description of Artificial Sequence: Synthetic peptide
SSPEGLFLYWFDP

SEQ ID NO: 967 - protein, 9 aa, Artificial Sequence
  Description of Artificial Sequence: Synthetic peptide
VEGSGSLDY

SEQ ID NO: 968 - protein, 9 aa, Artificial Sequence
  Description of Artificial Sequence: Synthetic peptide
RAGSEASDI

SEQ ID NO: 969 - protein, 15 aa, Artificial Sequence
  Description of Artificial Sequence: Synthetic peptide
ATYKRELRYYYGMDV

SEQ ID NO: 970 - protein, 15 aa, Artificial Sequence
  Description of Artificial Sequence: Synthetic peptide
ATYKRELRYYYGMDV

SEQ ID NO: 971 - protein, 8 aa, Artificial Sequence
  Description of Artificial Sequence: Synthetic peptide
VGKAVPDV

SEQ ID NO: 972 - protein, 13 aa, Artificial Sequence
  Description of Artificial Sequence: Synthetic peptide
HQGVAYYNYAMDV

SEQ ID NO: 973 - protein, 8 aa, Artificial Sequence
  Description of Artificial Sequence: Synthetic peptide
VVRDGMDV

SEQ ID NO: 974 - protein, 9 aa, Artificial Sequence
  Description of Artificial Sequence: Synthetic peptide
IPQTGTFDY

SEQ ID NO: 975 - protein, 15 aa, Artificial Sequence
  Description of Artificial Sequence: Synthetic peptide
ANYKRELRYYYGMDV

SEQ ID NO: 976 - protein, 11 aa, Artificial Sequence
  Description of Artificial Sequence: Synthetic peptide
ALVGATGAFDI

SEQ ID NO: 977 - protein, 8 aa, Artificial Sequence
  Description of Artificial Sequence: Synthetic peptide
WFGEGFDP

SEQ ID NO: 978 - protein, 17 aa, Artificial Sequence
  Description of Artificial Sequence: Synthetic peptide
VGYDSSGYYRDYYGMDV

SEQ ID NO: 979 - protein, 13 aa, Artificial Sequence
  Description of Artificial Sequence: Synthetic peptide
MGWSSGYLGAFDI

SEQ ID NO: 980 - protein, 13 aa, Artificial Sequence
  Description of Artificial Sequence: Synthetic peptide
GEIYYGYDGGFAY

SEQ ID NO: 981 - protein, 8 aa, Artificial Sequence
  Description of Artificial Sequence: Synthetic peptide
DYSYAMDY

SEQ ID NO: 982 - protein, 8 aa, Artificial Sequence
  Description of Artificial Sequence: Synthetic peptide
DYLYSLDF

SEQ ID NO: 983 - protein, 8 aa, Artificial Sequence
  Description of Artificial Sequence: Synthetic peptide
DYLYSCDY

SEQ ID NO: 984 - protein, 12 aa, Artificial Sequence
  Description of Artificial Sequence: Synthetic peptide
RASQSISSSFLA

SEQ ID NO: 985 - protein, 16 aa, Artificial Sequence
  Description of Artificial Sequence: Synthetic peptide
RSSQSLLHSNGYNYLD

SEQ ID NO: 986 - protein, 16 aa, Artificial Sequence
  Description of Artificial Sequence: Synthetic peptide
KSSQSLLRNDGKTPLY

SEQ ID NO: 987 - protein, 16 aa, Artificial Sequence
  Description of Artificial Sequence: Synthetic peptide
RSSQSLLHSNGYNYLN

SEQ ID NO: 988 - protein, 11 aa, Artificial Sequence
  Description of Artificial Sequence: Synthetic peptide
RASQSISSYLN

SEQ ID NO: 989 - protein, 16 aa, Artificial Sequence
  Description of Artificial Sequence: Synthetic peptide
RSSQSLLYSNGYNYVD

SEQ ID NO: 990 - protein, 11 aa, Artificial Sequence
  Description of Artificial Sequence: Synthetic peptide
RASQSVSSNLA

SEQ ID NO: 991 - protein, 11 aa, Artificial Sequence
  Description of Artificial Sequence: Synthetic peptide
RASQSVSSKLA

SEQ ID NO: 992 - protein, 12 aa, Artificial Sequence
  Description of Artificial Sequence: Synthetic peptide
RASQSVGSTNLA

SEQ ID NO: 993 - protein, 11 aa, Artificial Sequence
  Description of Artificial Sequence: Synthetic peptide
RASQSISSYLN

SEQ ID NO: 994 - protein, 11 aa, Artificial Sequence
  Description of Artificial Sequence: Synthetic peptide
RASQSISSYLN

SEQ ID NO: 995 - protein, 16 aa, Artificial Sequence
  Description of Artificial Sequence: Synthetic peptide
KSSESLVHNSGKTYLN

SEQ ID NO: 996 - protein, 11 aa, Artificial Sequence
  Description of Artificial Sequence: Synthetic peptide
QASEDINKFLN

SEQ ID NO: 997 - protein, 11 aa, Artificial Sequence
  Description of Artificial Sequence: Synthetic peptide
RASQSVGSNLA

SEQ ID NO: 998 - protein, 12 aa, Artificial Sequence
  Description of Artificial Sequence: Synthetic peptide
RASQSIGSSSLA

SEQ ID NO: 999 - protein, 11 aa, Artificial Sequence
  Description of Artificial Sequence: Synthetic peptide
KASQDIDDAMN

SEQ ID NO: 1000 - protein, 11 aa, Artificial Sequence
  Description of Artificial Sequence: Synthetic peptide
RASQDIYNNLA

SEQ ID NO: 1001 - protein, 16 aa, Artificial Sequence
  Description of Artificial Sequence: Synthetic peptide
RSSQSLLHSNGYNYLD

SEQ ID NO: 1002 - protein, 11 aa, Artificial Sequence
  Description of Artificial Sequence: Synthetic peptide
GGNNIGTKSVH

SEQ ID NO: 1003 - protein, 11 aa, Artificial Sequence
  Description of Artificial Sequence: Synthetic peptide
SGDGLSKKYVS

SEQ ID NO: 1004 - protein, 11 aa, Artificial Sequence
  Description of Artificial Sequence: Synthetic peptide
RASQGIRNWLA

SEQ ID NO: 1005 - protein, 11 aa, Artificial Sequence
  Description of Artificial Sequence: Synthetic peptide
GGNNIGSKSVH

SEQ ID NO: 1006 - protein, 11 aa, Artificial Sequence
  Description of Artificial Sequence: Synthetic peptide
QGDSLGNYYAT

SEQ ID NO: 1007 - protein, 12 aa, Artificial Sequence
  Description of Artificial Sequence: Synthetic peptide
RASQSVSSAYLA

SEQ ID NO: 1008 - protein, 11 aa, Artificial Sequence
  Description of Artificial Sequence: Synthetic peptide
RASQSVSNSLA

SEQ ID NO: 1009 - protein, 12 aa, Artificial Sequence
  Description of Artificial Sequence: Synthetic peptide
RASQSVSSSFLA

SEQ ID NO: 1010 - protein, 12 aa, Artificial Sequence
  Description of Artificial Sequence: Synthetic peptide
RASQSVSTTFLA

SEQ ID NO: 1011 - protein, 11 aa, Artificial Sequence
  Description of Artificial Sequence: Synthetic peptide
RASQSISSYLN

SEQ ID NO: 1012 - protein, 12 aa, Artificial Sequence
  Description of Artificial Sequence: Synthetic peptide
RATQSIGSSFLA

SEQ ID NO: 1013 - protein, 12 aa, Artificial Sequence
  Description of Artificial Sequence: Synthetic peptide
RASQSVSSSYLA

SEQ ID NO: 1014 - protein, 12 aa, Artificial Sequence
  Description of Artificial Sequence: Synthetic peptide
RASQSVSSSYLA

SEQ ID NO: 1015 - protein, 12 aa, Artificial Sequence
  Description of Artificial Sequence: Synthetic peptide
RASQRVASNYLA

SEQ ID NO: 1016 - protein, 12 aa, Artificial Sequence
  Description of Artificial Sequence: Synthetic peptide
RASQSLSSNFLA

SEQ ID NO: 1017 - protein, 16 aa, Artificial Sequence
  Description of Artificial Sequence: Synthetic peptide
RSSQSLLHSNGYNYLD

SEQ ID NO: 1018 - protein, 12 aa, Artificial Sequence
  Description of Artificial Sequence: Synthetic peptide
RASQSVSSSYLA

SEQ ID NO: 1019 - protein, 12 aa, Artificial Sequence
  Description of Artificial Sequence: Synthetic peptide
RASQSVASSFLA

SEQ ID NO: 1020 - protein, 11 aa, Artificial Sequence
  Description of Artificial Sequence: Synthetic peptide
RASQDVNTAVS

SEQ ID NO: 1021 - protein, 15 aa, Artificial Sequence
  Description of Artificial Sequence: Synthetic peptide
RASESVSVIGAHLIH

SEQ ID NO: 1022 - protein, 15 aa, Artificial Sequence
  Description of Artificial Sequence: Synthetic peptide
RASESVTILGSHLIY

SEQ ID NO: 1023 - protein, 15 aa, Artificial Sequence
  Description of Artificial Sequence: Synthetic peptide
RASESVTILGSHLIY

SEQ ID NO: 1024 - protein, 7 aa, Artificial Sequence
  Description of Artificial Sequence: Synthetic peptide
GASRRAT

SEQ ID NO: 1025 - protein, 7 aa, Artificial Sequence
  Description of Artificial Sequence: Synthetic peptide
LGSNRAS

SEQ ID NO: 1026 - protein, 7 aa, Artificial Sequence
  Description of Artificial Sequence: Synthetic peptide
EVSNRFS

SEQ ID NO: 1027 - protein, 7 aa, Artificial Sequence
  Description of Artificial Sequence: Synthetic peptide
LGSKRAS

SEQ ID NO: 1028 - protein, 7 aa, Artificial Sequence
  Description of Artificial Sequence: Synthetic peptide
GASTLAS

SEQ ID NO: 1029 - protein, 7 aa, Artificial Sequence
  Description of Artificial Sequence: Synthetic peptide
LGSNRAS

SEQ ID NO: 1030 - protein, 7 aa, Artificial Sequence
  Description of Artificial Sequence: Synthetic peptide
GASTRAS

SEQ ID NO: 1031 - protein, 7 aa, Artificial Sequence
  Description of Artificial Sequence: Synthetic peptide
GASIRAT

SEQ ID NO: 1032 - protein, 7 aa, Artificial Sequence
  Description of Artificial Sequence: Synthetic peptide
DASNRAT

SEQ ID NO: 1033 - protein, 7 aa, Artificial Sequence
  Description of Artificial Sequence: Synthetic peptide
AASSLQS

SEQ ID NO: 1034 - protein, 7 aa, Artificial Sequence
  Description of Artificial Sequence: Synthetic peptide
AASSLQS

SEQ ID NO: 1035 - protein, 7 aa, Artificial Sequence
  Description of Artificial Sequence: Synthetic peptide
EVSNRDS

SEQ ID NO: 1036 - protein, 7 aa, Artificial Sequence
  Description of Artificial Sequence: Synthetic peptide
DASTLQT

SEQ ID NO: 1037 - protein, 7 aa, Artificial Sequence
  Description of Artificial Sequence: Synthetic peptide
GASTRAT

SEQ ID NO: 1038 - protein, 7 aa, Artificial Sequence
  Description of Artificial Sequence: Synthetic peptide
GASSRAS

SEQ ID NO: 1039 - protein, 7 aa, Artificial Sequence
  Description of Artificial Sequence: Synthetic peptide
SATSPVP

SEQ ID NO: 1040 - protein, 7 aa, Artificial Sequence
  Description of Artificial Sequence: Synthetic peptide
AANKSQS

SEQ ID NO: 1041 - protein, 7 aa, Artificial Sequence
  Description of Artificial Sequence: Synthetic peptide
LGSNRAS

SEQ ID NO: 1042 - protein, 7 aa, Artificial Sequence
  Description of Artificial Sequence: Synthetic peptide
DDSVRPS

SEQ ID NO: 1043 - protein, 7 aa, Artificial Sequence
  Description of Artificial Sequence: Synthetic peptide
RDKERPS

SEQ ID NO: 1044 - protein, 7 aa, Artificial Sequence
  Description of Artificial Sequence: Synthetic peptide
AASNLQS

SEQ ID NO: 1045 - protein, 7 aa, Artificial Sequence
  Description of Artificial Sequence: Synthetic peptide
GKNNRPS

SEQ ID NO: 1046 - protein, 7 aa, Artificial Sequence
  Description of Artificial Sequence: Synthetic peptide
GTNNRPS

SEQ ID NO: 1047 - protein, 7 aa, Artificial Sequence
  Description of Artificial Sequence: Synthetic peptide
GASTRAT

SEQ ID NO: 1048 - protein, 7 aa, Artificial Sequence
  Description of Artificial Sequence: Synthetic peptide
DASSRAT

SEQ ID NO: 1049 - protein, 7 aa, Artificial Sequence
  Description of Artificial Sequence: Synthetic peptide
GASSRAT

SEQ ID NO: 1050 - protein, 7 aa, Artificial Sequence
  Description of Artificial Sequence: Synthetic peptide
GSSNRAT

SEQ ID NO: 1051 - protein, 7 aa, Artificial Sequence
  Description of Artificial Sequence: Synthetic peptide
AASSLQS

SEQ ID NO: 1052 - protein, 7 aa, Artificial Sequence
  Description of Artificial Sequence: Synthetic peptide
GASQRAT

SEQ ID NO: 1053 - protein, 7 aa, Artificial Sequence
  Description of Artificial Sequence: Synthetic peptide
GASSRAT

SEQ ID NO: 1054 - protein, 7 aa, Artificial Sequence
  Description of Artificial Sequence: Synthetic peptide
GASSRAT

SEQ ID NO: 1055 - protein, 7 aa, Artificial Sequence
  Description of Artificial Sequence: Synthetic peptide
GASSRAT

SEQ ID NO: 1056 - protein, 7 aa, Artificial Sequence
  Description of Artificial Sequence: Synthetic peptide
GASNWAT

SEQ ID NO: 1057 - protein, 7 aa, Artificial Sequence
  Description of Artificial Sequence: Synthetic peptide
LGSNRAS

SEQ ID NO: 1058 - protein, 7 aa, Artificial Sequence
  Description of Artificial Sequence: Synthetic peptide
GTSSRAT

SEQ ID NO: 1059 - protein, 7 aa, Artificial Sequence
  Description of Artificial Sequence: Synthetic peptide
GASGRAT

SEQ ID NO: 1060 - protein, 7 aa, Artificial Sequence
  Description of Artificial Sequence: Synthetic peptide
SASYRYT

SEQ ID NO: 1061 - protein, 7 aa, Artificial Sequence
  Description of Artificial Sequence: Synthetic peptide
LASNLET

SEQ ID NO: 1062 - protein, 7 aa, Artificial Sequence
  Description of Artificial Sequence: Synthetic peptide
LASNVQT

SEQ ID NO: 1063 - protein, 7 aa, Artificial Sequence
  Description of Artificial Sequence: Synthetic peptide
LASNVQT

SEQ ID NO: 1064 - protein, 10 aa, Artificial Sequence
  Description of Artificial Sequence: Synthetic peptide
QQYHSSPSWT

SEQ ID NO: 1065 - protein, 9 aa, Artificial Sequence
  Description of Artificial Sequence: Synthetic peptide
MQALQTPYT

SEQ ID NO: 1066 - protein, 8 aa, Artificial Sequence
  Description of Artificial Sequence: Synthetic peptide
MQNIQFPS

SEQ ID NO: 1067 - protein, 9 aa, Artificial Sequence
  Description of Artificial Sequence: Synthetic peptide
MQALQTPYT

SEQ ID NO: 1068 - protein, 8 aa, Artificial Sequence
  Description of Artificial Sequence: Synthetic peptide
QQSYKRAS

SEQ ID NO: 1069 - protein, 9 aa, Artificial Sequence
  Description of Artificial Sequence: Synthetic peptide
MQGRQFPYS

SEQ ID NO: 1070 - protein, 8 aa, Artificial Sequence
  Description of Artificial Sequence: Synthetic peptide
QQYGSSLT

SEQ ID NO: 1071 - protein, 9 aa, Artificial Sequence
  Description of Artificial Sequence: Synthetic peptide
QQYGSSSWT

SEQ ID NO: 1072 - protein, 10 aa, Artificial Sequence
  Description of Artificial Sequence: Synthetic peptide
QQYGSSPPWT

SEQ ID NO: 1073 - protein, 7 aa, Artificial Sequence
  Description of Artificial Sequence: Synthetic peptide
QQSYTLA

SEQ ID NO: 1074 - protein, 9 aa, Artificial Sequence
  Description of Artificial Sequence: Synthetic peptide
QQSYSTPYT

SEQ ID NO: 1075 - protein, 9 aa, Artificial Sequence
  Description of Artificial Sequence: Synthetic peptide
MQGTHWPGT

SEQ ID NO: 1076 - protein, 9 aa, Artificial Sequence
  Description of Artificial Sequence: Synthetic peptide
QQYESLPLT

SEQ ID NO: 1077 - protein, 10 aa, Artificial Sequence
  Description of Artificial Sequence: Synthetic peptide
QQYNDWLPVT

SEQ ID NO: 1078 - protein, 10 aa, Artificial Sequence
  Description of Artificial Sequence: Synthetic peptide
QQYAGSPPFT

SEQ ID NO: 1079 - protein, 9 aa, Artificial Sequence
  Description of Artificial Sequence: Synthetic peptide
LQHDNFPLT

SEQ ID NO: 1080 - protein, 9 aa, Artificial Sequence
  Description of Artificial Sequence: Synthetic peptide
QHYYRFPYS

SEQ ID NO: 1081 - protein, 9 aa, Artificial Sequence
  Description of Artificial Sequence: Synthetic peptide
MQALQTPYT

SEQ ID NO: 1082 - protein, 11 aa, Artificial Sequence
  Description of Artificial Sequence: Synthetic peptide
QVWDSDSEHVV

SEQ ID NO: 1083 - protein, 9 aa, Artificial Sequence
  Description of Artificial Sequence: Synthetic peptide
QAWDDTTVV

SEQ ID NO: 1084 - protein, 9 aa, Artificial Sequence
  Description of Artificial Sequence: Synthetic peptide
QKYNSAPFT

SEQ ID NO: 1085 - protein, 12 aa, Artificial Sequence
  Description of Artificial Sequence: Synthetic peptide
SSRDSSGDHLRV

SEQ ID NO: 1086 - protein, 11 aa, Artificial Sequence
  Description of Artificial Sequence: Synthetic peptide
NSRDSSGHHLL

SEQ ID NO: 1087 - protein, 14 aa, Artificial Sequence
  Description of Artificial Sequence: Synthetic peptide
QHYGSSFNGSSLFT

SEQ ID NO: 1088 - protein, 10 aa, Artificial Sequence
  Description of Artificial Sequence: Synthetic peptide
QQFGTSSGLT

SEQ ID NO: 1089 - protein, 10 aa, Artificial Sequence
  Description of Artificial Sequence: Synthetic peptide
QQYHSSPSWT

SEQ ID NO: 1090 - protein, 10 aa, Artificial Sequence
  Description of Artificial Sequence: Synthetic peptide
QQYHSSPSWT

SEQ ID NO: 1091 - protein, 9 aa, Artificial Sequence
  Description of Artificial Sequence: Synthetic peptide
QQSYSTPYS

SEQ ID NO: 1092 - protein, 10 aa, Artificial Sequence
  Description of Artificial Sequence: Synthetic peptide
QHYESSPSWT

SEQ ID NO: 1093 - protein, 10 aa, Artificial Sequence
  Description of Artificial Sequence: Synthetic peptide
QQYGSPPRFT

SEQ ID NO: 1094 - protein, 10 aa, Artificial Sequence
  Description of Artificial Sequence: Synthetic peptide
QHYGSSPSWT

SEQ ID NO: 1095 - protein, 10 aa, Artificial Sequence
  Description of Artificial Sequence: Synthetic peptide
QHYDSSPSWT

SEQ ID NO: 1096 - protein, 10 aa, Artificial Sequence
  Description of Artificial Sequence: Synthetic peptide
QYYGTSPMYT

SEQ ID NO: 1097 - protein, 9 aa, Artificial Sequence
  Description of Artificial Sequence: Synthetic peptide
MQALQTPLT

SEQ ID NO: 1098 - protein, 11 aa, Artificial Sequence
  Description of Artificial Sequence: Synthetic peptide
QHYGNSPPKFT

SEQ ID NO: 1099 - protein, 10 aa, Artificial Sequence
  Description of Artificial Sequence: Synthetic peptide
QHYGGSPRLT

SEQ ID NO: 1100 - protein, 9 aa, Artificial Sequence
  Description of Artificial Sequence: Synthetic peptide
QQHYSTPWT

SEQ ID NO: 1101 - protein, 9 aa, Artificial Sequence
  Description of Artificial Sequence: Synthetic peptide
LQSRIFPRT

SEQ ID NO: 1102 - protein, 9 aa, Artificial Sequence
  Description of Artificial Sequence: Synthetic peptide
LQSRTIPRT

SEQ ID NO: 1103 - protein, 9 aa, Artificial Sequence
  Description of Artificial Sequence: Synthetic peptide
LQSRTIPRT

SEQ ID NO: 1104 - protein, 41 aa, Artificial Sequence
  Description of Artificial Sequence: Synthetic polypeptide
RSKRSRLLHSDYMNMTPRRPGPTRKHYQPYAPPRDFAAYRS

SEQ ID NO: 1105 - DNA, 123 bp, Artificial Sequence; identical to SEQ ID NO: 19
  Description of Artificial Sequence: Synthetic polynucleotide

SEQ ID NO: 1106 - protein, 35 aa, Artificial Sequence
  Description of Artificial Sequence: Synthetic polypeptide
TKKKYSSSVHDPNGEYMFMRAVNTAKKSRLTDVTL

SEQ ID NO: 1107 - DNA, 105 bp, Artificial Sequence
  Description of Artificial Sequence: Synthetic polynucleotide
acaaaaaagaagtattcatccagtgtgcacgaccctaacggtgaatacatgttcatgagagcagtgaacacagccaaaaaatccagactcacagatgtgacccta

SEQ ID NO: 1108 - protein, 18 aa, Artificial Sequence
  Description of Artificial Sequence: Synthetic peptide
GSTSGSGKPGSGEGSTKG

SEQ ID NO: 1109 - DNA, 521 bp, Unknown
  Description of Unknown: Wild-type PGK promoter polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 1110 - DNA, 118 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtg

SEQ ID NO: 1111 - DNA, 221 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 1112 - DNA, 324 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 1113 - DNA, 422 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 1114 - protein, 21 aa, Artificial Sequence
  Description of Artificial Sequence: Synthetic peptide
  MISC_FEATURE (1)..(3): May or may not be present
GSGEGRGSLLTCGDVEENPGP

SEQ ID NO: 1115 - protein, 22 aa, Artificial Sequence
  Description of Artificial Sequence: Synthetic peptide
  MISC_FEATURE (1)..(3): May or may not be present
GSGATNFSLLKQAGDVEENPGP

SEQ ID NO: 1116 - protein, 23 aa, Artificial Sequence
  Description of Artificial Sequence: Synthetic peptide
  MISC_FEATURE (1)..(3): May or may not be present
GSGQCTNYALLKLAGDVESNPGP

SEQ ID NO: 1117 - protein, 25 aa, Artificial Sequence
  Description of Artificial Sequence: Synthetic peptide
  MISC_FEATURE (1)..(3): May or may not be present
GSGVKQTLNFDLLKLAGDVESNPGP

What is claimed is:

1. An isolated nucleic acid molecule encoding a chimeric antigen receptor (CAR), wherein the CAR comprises an anti-B-cell maturation antigen (BCMA) binding domain, a transmembrane domain, and an intracellular signaling domain, wherein said anti-BCMA binding domain comprises:
   (i) a heavy chain complementary determining region 1 (HC CDR1) comprising the amino acid sequence of SEQ ID NO: 394, a heavy chain complementary determining region 2 (HC CDR2) comprising the amino acid sequence of SEQ ID NO: 434, a heavy chain complementary determining region 3 (HC CDR3) comprising the amino acid sequence of SEQ ID NO: 474, a light chain complementary determining region 1 (LC CDR1) comprising the amino acid sequence of SEQ ID NO: 514, a light chain complementary determining region 2 (LC CDR2) comprising the amino acid sequence of SEQ ID NO: 554, and a light chain complementary determining region 3 (LC CDR3) comprising the amino acid sequence of SEQ ID NO: 594;
   (ii) a HC CDR1 comprising the amino acid sequence of SEQ ID NO: 634, a HC CDR2 comprising the amino acid sequence of SEQ ID NO: 674, a HC CDR3 comprising the amino acid sequence of SEQ ID NO: 714, a LC CDR1 comprising the amino acid sequence of SEQ ID NO: 754, a LC CDR2 comprising the amino acid sequence of SEQ ID NO: 794, and a LC CDR3 comprising the amino acid sequence of SEQ ID NO: 834; or
   (iii) a HC CDR1 comprising the amino acid sequence of SEQ ID NO: 874, a HC CDR2 comprising the amino acid sequence of SEQ ID NO: 914, a HC CDR3 comprising the amino acid sequence of SEQ ID NO: 954, a LC CDR1 comprising the amino acid sequence of SEQ ID NO: 994, a LC CDR2 comprising the amino acid sequence of SEQ ID NO: 1034, and a LC CDR3 comprising the amino acid sequence of SEQ ID NO: 1074, and wherein:
   the intracellular signaling domain comprises a primary signaling domain comprising a functional signaling domain of CD3 zeta or an amino acid sequence with 95-99% identity thereof.

2. The isolated nucleic acid molecule of claim 1, which encodes a CAR comprising:
   (i) the amino acid sequence of a light chain variable region comprising the amino acid sequence of SEQ ID NO: 94;
   (ii) an amino acid sequence having at least one, two or three modifications but not more than 30, 20 or 10 modifications of the amino acid sequence of a light chain variable region comprising the amino acid sequence of SEQ ID NO: 94; or (iii) an amino acid sequence with 95-99% identity to the amino acid sequence of a light chain variable region comprising the amino acid sequence of SEQ ID NO: 94.

3. The isolated nucleic acid molecule of claim 1, which encodes a CAR comprising:
(i) the amino acid sequence of a heavy chain variable region comprising the amino acid sequence of SEQ ID NO: 79;
(ii) an amino acid sequence having at least one, two or three modifications but not more than 30, 20 or 10 modifications of the amino acid sequence of a heavy chain variable region comprising the amino acid sequence of SEQ ID NO: 79; or
(iii) an amino acid sequence with 95-99% identity to the amino acid sequence of a heavy chain variable region comprising the amino acid sequence of SEQ ID NO: 79.

4. The isolated nucleic acid molecule of claim 1, which encodes a CAR comprising the amino acid sequence of a light chain variable region comprising the amino acid sequence of SEQ ID NO: 94, and the amino acid sequence of a heavy chain variable region comprising the amino acid sequence of SEQ ID NO: 79.

5. The isolated nucleic acid molecule of claim 1, comprising a nucleic acid sequence encoding the anti-BCMA binding domain, wherein the nucleic acid sequence comprises the nucleotide sequence of SEQ ID NO: 64, or a sequence with 95-99% identity thereof.

6. The isolated nucleic acid molecule of claim 1, wherein:
(i) the encoded CAR comprises a transmembrane domain that comprises a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154;
(ii) the encoded transmembrane domain comprises the amino acid sequence of SEQ ID NO: 6, an amino acid sequence comprising at least one, two or three modifications but not more than 20, 10 or 5 modifications of the amino acid sequence of SEQ ID NO:6, or a sequence with 95-99% identity to the amino acid sequence of SEQ ID NO:6; or
(iii) the isolated nucleic acid molecule comprises a nucleic acid sequence encoding the transmembrane domain, wherein the nucleic acid sequence comprises the nucleotide sequence of SEQ ID NO:17, or a nucleotide sequence with 95-99% identity thereof.

7. The isolated nucleic acid molecule of claim 1, wherein the encoded anti-BCMA binding domain comprises:
(i) the amino acid sequence of SEQ ID NO: 49;
(ii) an amino acid sequence having at least one, two or three modifications but not more than 30, 20 or 10 modifications to SEQ ID NO: 49; or
(iii) an amino acid sequence with 95-99% identity to SEQ ID NO: 49.

8. The isolated nucleic acid molecule of claim 1, wherein the encoded anti-BCMA binding domain is connected to the transmembrane domain by a hinge region, wherein (i) the encoded hinge region comprises the amino acid sequence of SEQ ID NO:2, or a sequence with 95-99% identity thereof; or (ii) the isolated nucleic acid molecule comprises a nucleic acid sequence encoding the hinge region, wherein the nucleic acid sequence comprises the nucleotide sequence of SEQ ID NO: 13, or a sequence with 95-99% identity thereof.

9. The isolated nucleic acid molecule of claim 1, wherein the encoded intracellular signaling domain comprises a costimulatory domain, wherein the costimulatory domain comprises a functional signaling domain derived from a protein selected from the group consisting of MHC class I molecules, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, 4-1BB (CD137), B7-H3, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

10. The isolated nucleic acid molecule of claim 1, wherein the encoded intracellular signaling domain comprises a costimulatory domain, wherein the costimulatory domain comprises the amino acid sequence of SEQ ID NO:7, or a sequence with 95-99% identity to the amino acid sequence of SEQ ID NO:7.

11. The isolated nucleic acid molecule of claim 1, wherein the encoded intracellular signaling domain comprises a costimulatory domain, wherein the isolated nucleic acid molecule comprises a nucleic acid sequence encoding the costimulatory domain, wherein the nucleic acid sequence comprises the nucleotide sequence of SEQ ID NO:18, or a sequence with 95-99% identity thereof.

12. The isolated nucleic acid molecule of claim 1, wherein the encoded intracellular signaling domain comprises a functional signaling domain of 4-1BB and a functional signaling domain of CD3 zeta.

13. The isolated nucleic acid molecule of claim 1, wherein the encoded intracellular signaling domain comprises the amino acid sequence of SEQ ID NO: 7 and the amino acid sequence of SEQ ID NO:9 or SEQ ID NO:10; or a sequence with 95-99% identity to the amino acid sequence of SEQ ID NO:7 and the amino acid sequence of SEQ ID NO:9 or SEQ ID NO:10.

14. The isolated nucleic acid molecule of claim 1, wherein the encoded intracellular signaling domain comprises the amino acid sequence of SEQ ID NO:7 and the amino acid sequence of SEQ ID NO:9 or SEQ ID NO:10, wherein the amino acid sequences comprising the intracellular signaling domain are expressed in the same frame and as a single polypeptide chain.

15. The isolated nucleic acid molecule of claim 1, comprising a nucleic acid sequence encoding the intracellular signaling domain, wherein the nucleic acid sequence comprises the nucleotide sequence of SEQ ID NO:18, or a sequence with 95-99% identity thereof, and/or the nucleotide sequence of SEQ ID NO:20 or SEQ ID NO:21, or a sequence with 95-99% identity thereof.

16. The isolated nucleic acid molecule of claim 1, further comprising a leader sequence which encodes the amino acid sequence of SEQ ID NO: 1.

17. The isolated nucleic acid molecule of claim 1, which encodes a CAR comprising:
  (i) the amino acid sequence of SEQ ID NO: 109;
  (ii) an amino acid sequence having at least one, two or three modifications but not more than 30, 20 or 10 modifications to SEQ ID NO: 109; or
  (iii) an amino acid sequence with 95-99% identity to SEQ ID NO: 109,
  with or without a leader sequence comprising the amino acid of SEQ ID NO:1.

18. The isolated nucleic acid molecule of claim 1, comprising the nucleotide sequence of SEQ ID NO: 124, or a nucleotide sequence with 95-99% identity to SEQ ID NO: 124.

19. A vector comprising the nucleic acid molecule of claim 1, wherein the vector is a DNA vector, a RNA vector, a plasmid, a lentivirus vector, an adenoviral vector, or a retrovirus vector.

20. A method of making an immune effector cell, comprising transducing the immune effector cell with the vector of claim 19.

21. The method of claim 20, wherein the immune effector cell is a T cell.

22. An immune effector cell comprising the nucleic acid molecule of claim 1.

23. The cell of claim 22, further expressing a molecule that comprises a first polypeptide that comprises at least a portion of an inhibitory molecule, associated with a second polypeptide that comprises a positive signal from an intracellular signaling domain.

24. A method of generating a population of RNA-engineered cells comprising introducing an in vitro transcribed RNA or synthetic RNA into a cell, wherein the RNA comprises the nucleic acid molecule of claim 1.

25. The isolated nucleic acid molecule of claim 1, wherein the encoded intracellular signaling domain comprises the amino acid sequence of SEQ ID NO: 9 or SEQ ID NO: 10, or a sequence with 95-99% identity to the amino acid sequence of SEQ ID NO: 9 or SEQ ID NO: 10.

26. The isolated nucleic acid molecule of claim 1, wherein the encoded CAR is expressed in frame and as a single polypeptide chain.

27. An immune effector cell comprising a CAR encoded by the nucleic acid molecule of claim 1, wherein:
  (i) said LC CDR1, LC CDR2, and LC CDR3 comprise the amino acid sequences of SEQ ID NOs: 514, 554, and 594, respectively; and
  (ii) said HC CDR1, HC CDR2 and HC CDR3 comprise the amino acid sequences of SEQ ID NOs: 394, 434, and 474, respectively.

28. The immune effector cell of claim 27, wherein the CAR comprises:
  (i) the amino acid sequence of a light chain variable region comprising the amino acid sequence of SEQ ID NO: 94;
  (ii) an amino acid sequence having at least one, two or three modifications but not more than 30, 20 or 10 modifications of the amino acid sequence of a light chain variable region comprising the amino acid sequence of SEQ ID NO: 94;
  (iii) an amino acid sequence with 95-99% identity to the amino acid sequence of a light chain variable region comprising the amino acid sequence of SEQ ID NO: 94;
  (iv) the amino acid sequence of a heavy chain variable region comprising the amino acid sequence of SEQ ID NO: 79;
  (v) an amino acid sequence having at least one, two or three modifications but not more than 30, 20 or 10 modifications of the amino acid sequence of a heavy chain variable region comprising the amino acid sequence of SEQ ID NO: 79; or
  (vi) an amino acid sequence with 95-99% identity to the amino acid sequence of a heavy chain variable region comprising the amino acid sequence of SEQ ID NO: 79; or
  (vii) any of (i)-(iii) and any of (iv)-(vi).

29. The immune effector cell of claim 27, wherein the CAR comprises:
  (i) the amino acid sequence of SEQ ID NO: 49;
  (ii) an amino acid sequence having at least one, two or three modifications but not more than 30, 20 or 10 modifications SEQ ID NO: 49; or
  (iii) an amino acid sequence with 95-99% identity to SEQ ID NO: 49.

30. The immune effector cell of claim 27, wherein the transmembrane domain comprises a transmembrane domain from a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154.

31. The immune effector cell of claim 27, wherein the transmembrane domain comprises:
  (i) the amino acid sequence of SEQ ID NO: 6;
  (ii) an amino acid sequence having at least one, two or three modifications but not more than 20, 10 or 5 modifications of the amino acid sequence of SEQ ID NO: 6; or
  (iii) a sequence with 95-99% identity to the amino acid sequence of SEQ ID NO: 6.

32. The immune effector cell of claim 27, wherein the anti-BCMA binding domain is connected to the transmembrane domain by a hinge region, wherein the hinge region comprises the amino acid sequence of SEQ ID NO:2 or SEQ ID NO:36, or a sequence with 95-99% identity thereof.

33. The immune effector cell of claim 27, wherein the encoded intracellular domain comprises a costimulatory domain, wherein the costimulatory domain comprises a functional signaling domain derived from a protein selected from the group consisting of MHC class I molecules, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, 4-1BB (CD137), B7-H3, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

34. The immune effector cell of claim 27, wherein the costimulatory domain comprises the amino acid sequence of SEQ ID NO: 7, or a sequence with 95-99% identity to the amino acid sequence of SEQ ID NO: 7.

35. The immune effector cell of claim 27, wherein the intracellular signaling domain comprises a functional signaling domain of 4-1BB and a functional signaling domain of CD3 zeta.

36. The immune effector cell of claim 27, wherein the intracellular signaling domain comprises the amino acid sequence of SEQ ID NO: 7 and the amino acid sequence of SEQ ID NO: 9 or SEQ ID NO: 10, or a sequence with 95-99% identity to the amino acid sequence of SEQ ID NO:7 and the amino acid sequence of SEQ ID NO:9 or SEQ ID NO:10.

37. The immune effector cell of claim 27, wherein the CAR comprises:
   (i) the amino acid sequence of SEQ ID NO: 109;
   (ii) an amino acid sequence having at least one, two or three modifications but not more than 30, 20 or 10 modifications to SEQ ID NO: 109; or
   (iii) an amino acid sequence with 95-99% identity to SEQ ID NO: 109,
   with or without a leader sequence comprising the amino acid of SEQ ID NO:1.

38. The immune effector cell of claim 27, further expressing a molecule that comprises a first polypeptide that comprises at least a portion of an inhibitory molecule, associated with a second polypeptide that comprises a positive signal from an intracellular signaling domain.

39. The immune effector cell of claim 27, wherein the immune effector cell is a T cell.

40. A pharmaceutical composition comprising an antitumor effective amount of a population of human T cells, wherein the cells of the population include cells that comprise the nucleic acid molecule of claim 1.

41. The pharmaceutical composition of claim 40, further comprising a pharmaceutically acceptable carrier, diluent, or excipient.

42. An immune effector cell comprising a CAR expressed by the nucleic acid molecule of claim 1.

43. The immune effector cell of claim 42, wherein the immune effector cell is a T cell.

44. An isolated nucleic acid molecule encoding a chimeric antigen receptor (CAR), wherein the CAR comprises an anti-B-cell maturation antigen (BCMA) binding domain, a transmembrane domain, and an intracellular signaling domain, wherein the anti-BCMA binding domain comprises the amino acid sequence of SEQ ID NO: 49, and wherein the intracellular signaling domain comprises a primary signaling domain comprising a functional signaling domain of CD3 zeta or an amino acid sequence with 95-99% identity thereof.

45. An isolated nucleic acid molecule encoding a chimeric antigen receptor (CAR), wherein the CAR comprises, from N-terminus to C-terminus:
   an anti-B-cell maturation antigen (BCMA) binding domain comprising the amino acid sequence of SEQ ID NO: 49,
   a transmembrane domain comprising the amino acid sequence of SEQ ID NO: 6,
   a costimulatory domain comprising the amino acid sequence of SEQ ID NO: 7, and
   a primary signaling domain comprising the amino acid sequence of SEQ ID NO: 9.

46. A vector comprising the nucleic acid molecule of claim 45.

47. A cell comprising the vector of claim 46.

48. A pharmaceutical composition comprising the cell of claim 47.

49. An isolated nucleic acid molecule encoding a chimeric antigen receptor (CAR), wherein the CAR comprises an anti-B-cell maturation antigen (BCMA) binding domain, a transmembrane domain, and an intracellular signaling domain, wherein the CAR comprises the amino acid sequence of SEQ ID NO: 109 without a leader sequence comprising the amino acid of SEQ ID NO: 1.

50. An isolated nucleic acid molecule comprising the nucleotide sequence of SEQ ID NO: 124.

* * * * *

UNITED STATES PATENT AND TRADEMARK OFFICE
CERTIFICATE OF CORRECTION

Page 1 of 1

PATENT NO.        : 10,174,095 B2
APPLICATION NO.   : 14/805193
DATED             : January 8, 2019
INVENTOR(S)       : Brogdon et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 166 days.

Signed and Sealed this
Thirtieth Day of July, 2019

Andrei Iancu
*Director of the United States Patent and Trademark Office*